United States Patent 7,745,391 (HUMAN THROMBOSPONDIN POLYPEPTIDE) - sequence listing, part 194

SEQ ID NO: 461013 - DNA, 2630 bp, Homo sapiens
atcacaggccgtacgctggaggctggagccgcggtaggacggctcgcctcgctgcggtttgtggtgacggcaacggagaaagcagtgtggcgcaagcggtcccctgaagaccttgccaaagtgtgagatcgccctggagaaactcaagaatgacatggcggtggcaccaaccccttcctcaggtcgatgcaccaccgcgtgacctccaggcggctgcagctcccggacaagcactaggttaccaccttgctcagcacctgtgcccagagcatccacaaggcctgcctctcggctgcctagccaggactgcagggatggcccgcagcctcatcggggccaaggatgcatgcctcctggagttggctgtcttcttggagaaggcactccatgtgacttcctccatgaagccagacacagtccccagccacgatcctcgggctgctctcaccacggcctgtccaggtcttatatttaaagaaaaagtaacaagccttaaatttaaagaaaaacctacaggcctggagacaagaagctcgcagaccaaactagaagtggccctgtacatgtttctgcggaaccctgacactgaagctgttctggttgccatgtcctgtttccgccacctctgtgaggaagcagatacccggtgtggggtggacgaagtgtcattgcgtaacctcttgcccaactctaacacattcatggagtttgcctgtcagcaatgtgatgtcaacagctatccaaaagcccaaatggaagatggccagaggcgaatgtcccatgtgagtggaggaggacccatagatttgtctgacacagactccctacaggcatggatcaacatgactggcttcctttgtgcccttgggggagtgtgcctccagcagagaaggaattctggcctggcaacctatagcccacccgtggatataatgaagaacttgctagataatcatactgaaggcagctctgaacatctagagcaagctagcattgaaacaatgatgttaaatctggtcagccacatcaccatcctggtggaaccctcctgtgaggacagccaaggcctgaactacctgcgggtttgcccaggcaaccagccagccctggtccaaggcatcctggagcgagttgtggatggccccgtgccccaccagacagtgcgcctggaggacctggacgagagcggtgagccccaggctggggagccagtgctgcctggcatcctccggccaccctacctggctgaggggctgggcctgggcctgccggtgacagccatccctgtccttcctgctgagggggcaggcttactgcactacctctccaagatgcttttgatggtagctacaggattgctaagaccgtatatgggaaagggctttgtaaactgtgaggcttttttatgtaaagcagaacatgatgtccctggagctcccggtccctggagctccgcacttgggggcacaacctgcatgaggcagcgccactctggtgactggccggccatgccgtcccgggctgaggactatgaagtgttgtacaccattggcacaggctcctatggccgctgccagaagatccggaggaagagtgacagcaagatattagtttggaaagaacttgattatggcttcatgacagaagctgagaaacagatgcttatttctgaagtgaatttgctttgtaaactgaaaaatccaaacatcgttcattactatgatcgtattattgaccggaccaacacaacactgtacattgtaatggaatattgtgaagaaggagacctggctagtgtaattacaaagggaaccaaggaaaggcaatacttagatgaagagtttgttcttcgagtgacaactcagttgactctggccctgaagatgttaaaggattaccatcgaccttctgttgaagaaattctcgagaaccctttaatagcagatttggttgcagaagagcaaagaagaaatcttgagagaagagggcgacaattaggagagccagaaaaattgccggattccagccctgtattgagtgagctgaaactaaaggaaattcagttagaggagcaagagcgagctctcaaagcaggagaagaaaggttggagcagaaagaacaggagctttgtgtttgtgagagactagcagaggacagactgactataccagaaaatctgttgaagaattacagcttgctaaaggaacagaagttcctgtctctggcaagtagtccagaacttcttaatcttccatcctcagtaattaagaagaaagttcatttcagtggggaaagtaaagagaatgtcatgaggaaggtttcagaaacaggttagaaaatgcttccatagtatttcatagattctttataatttgagcagtttttcagggttttcagtccatttaaaccatttatctaatgaacagtaaatagaaactctgagctctacattctcttgtaagctttctttttctgttatagttgagcaaatttgttgacattcttatatttttgcattttgattttttgcaaaatgtttggttaaaatactttgggggaaaaatgcaagtactttgttctcatttatagttgacttcctactttgtttatgttgtcttctgtatgtatt

SEQ ID NO: 461014 - DNA, 5502 bp, Homo sapiens
ttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactctaaaagaatatcagcaaaggaagagccctggtattccagcaggagcaaagacaaaaaagaaaaaaactgacagtagccctgagacaaccacttccggtggtggccactcacctggggatattcaggacattctgaaggtgcgggtgtccaaccttaaccactccaatgggagccagtaccaagaactagcagtagccctggagtcaagctcagtgacaatcaatcagctcaatgaaaacatagaatcattggcaaagaaaacaaacaatgaaatacacaaagcacaaatggagcagttagagacaatcaacatcctcacattggaaaaggcagacttgaagaccaccctttaccatactaaacgtgctgcccgacacttcgaagaagagtccaaggatctggctggccgcctgcaatactccttacagcatattcaagaattggagcgggctctctgtgctgtgtctacacagcagcaggaagaggacagggggcactgcccgagctccccagatcaaaacttctcactcttcaccatccagtcctcgagctgcagagaagcggtcctccagcggcggttacagcagaccataaaggagcgggcgctgctgaacgcacacgtgacacaggtgacagagtcactaaaacaagtccagctagagcgagacgaatatgctaaacacataaaaggagagagggcccggtggcaggagaggatgtggaaaatgtcggtggaggctcgaacattgaaggaagagaagaagcgtgacatacatcggatacaggagctggagaggagcttgtccgaactcaaaaaccagatggctgagcccccatccctggcacccccagcagtgacctctgtggtggaacagctacaagatgaggccaaacacctgaggcaggaggtggaaggtctggagggaaagctccagtcccaggtggaaaacaatcaggccttgagtctccttagcaaggaacaaaagcagagactccaggagcaggaggagatgctccgagagcaggaggcgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctgaacaacgagaaaaagagcgcactgcagttggagcagcaagtaaaggagctgcaggagaagctagacgaggtgaaggagatgcagtacatggccacctatcagcagctgacctctgagaaggaggcgctgcacaggcagttactgctgcagacccagttcgtggaccagctgcagcagcaggaagcttggggcaaagcggagcacctagaagctgccagccagcggaaccaacagctagagacccagctaagcctcgtggctctccctggagaaggagatggaggacaacatctggacagtgaggaggaggaggcgcctcggcccacgccaaacatcccagaggacctggagagccgggaggccacggagccagaggcagaggccccagccccagggaggactggagatgagtttgtgtgtggggagagctaccgggccctgaaggaggccatggtgaagctgaaagggagagagtccttcaccgtatatgaaagccagggggcagtgccaaacacgcggcaccaggagatggaggatgtcatcaggctggcccagaaggaggaggagatgaaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagtggccagggagggttctccccataacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacttttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctattacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgcactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcaaccacactagttactctgacataggaatttacttcttttctttgaatggaaaacactttaaaaataataacaatcattattataaaccaatatatgtgagagtacttagttgaaacaaaaaggagttttagtagacagtattatactacacatgaaaatcaaggtgaagtttatgcaacttaaaatgtttacaagctgccgtgcaatctactgtttgtgagtgtccaagtattatgagaaaaagtgtctatacaatgacagacttatgtttcctcacaaagttcttcacaaagagtgaaatatgtttttatacctctcggtttcagttagaggcatattttgtgccatatttatgttaatgtgcctatacatgatgagtgaattatttcagtcatacattgcctaaatcataactttaagatgcttgggaaagaatcaacagctaaaagttcatgaagttctaatgtctgtgttccaaaatacgtcacattattaggatgcagggagagatgtgtgtgcgctccctggggtgggcatttctagttactagaccatctccatttttagcatttggcatcttcatgatacttttatacatatgacattaataggagagcaataatacgattttacagatggaataacagatgtgcctgcattcactgaaagagtgcaaatattaagtccttgtgacttcaactgactcttccaaattgtatgaatttatcaatgtattagataaacccagtttcagaattataaagaaaaactgttagaccaactaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcatatcactgttaattagccaccttatttggtctaacagtgggtttacctaatacattgataaattatttcaaaggtatttttatagttcaaatcacttcacttttaccctgataaatataaatgactaggaatgatcttcagatagcctttagcacctgcaaccaatctgacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcgtatgacaacaacttaagtctttcttcaaagtgcatgtggtcctttgcaatacctcattcagccaagtatttgttctcttcctcattcagtataaggcagctttcaatttgcttagaaggcaacattagaagggtagagtttaatcagaaacatagaattttaaagtgtgggttcaactgaataaatctgaatttctgtaggaagtaaagaattaaaaaccgatttaaagattgcaatatataatcatttttaaagtatttgattaaatctgataggttttccagaaatgaaaaaaagtcagttctaaaaccaaagctgatatttagaaaatgtgaaaatgtaaatcagccctatccataatagtttctctaaaactttatcttaaagagtcattttaaaagaatataactattcaaaaatgtaactgctatcttaagttttaaaataagttaagacattttgaaatatgaata

SEQ ID NO: 461015 - DNA, 1776 bp, Homo sapiens
tcccacagctagactgccacagagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagaccgagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggaaaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagcaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtca

SEQ ID NO: 461016 - DNA, 1586 bp, Homo sapiens
tcccacagctagactgccacagagctggagggagaggagagattaaagtgaggagagagctacaaccaagtaagcaagtgtcagggctcaccaaccatgcaaggacagggcaggagaagaggaacctgcaaaggctggttttggagaccccgagtcagaacatcttcttctcccctgtgagtgtctccacttccctggccatgctctcccttggggcccactcagtcaccaagaccgagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggaaaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagcaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtca

SEQ ID NO: 461017 - DNA, 782 bp, Homo sapiens
tctgggtcacatttttgtggatacagaagccaggctggagtggaccagtgagtgagttggagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagaccgagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccagtggcaaaagccctttaccctggatattccagaaagaattcccttcctggtggggaacagtcatgtttttcc

SEQ ID NO: 461018 - DNA, 2610 bp, Homo sapiens
aggccgaggaggcgcccagagcgagtgagggctgtgagggctaccagcatgctgtcacctctcaaaagaagacggccactgtcctccagtcgccagaatggtagattcactgccagcatgcactgtgtgcctagaaaaactgcaggcactcaatgccagcctgtgaaagcacccatgggtgctgtaccctgcagaggcacaggggaagagctgcgcaaggtcttcaaagcccaccaccacttatatcagtgtgcccttaatagtagatccatgccatacctgcaggctctatacatctctcaccagttcaacctatggaggacaatggggaatgaagaactagcaccaaatgtaatcagctataacaagaagattcttaaatttatgtggaaattcaaagagccaaatagtaaaagcaaccctgaacaagaacaaaacaagatcatctttactataatatattaaaaatataaatgactacaaattgcaagaattcaaagtagaagaactgcaagtgtttgagaaataattgcgaaacagagtacagcatatggtagaactgaaggattttggctctggaaagcaatgcctaggttttgaattcagattctgtcatttaccaactttgtgaccttggatgaattattgggggctatgcctcaatttcatgtcacatacaatggtgctaatattaacacctatcttattgggttgttgtgagaattcaataaattaaattcttagattattgaaataatcaatttaaataaataatttagtgtccggaacatatttagcattcaataaacatgaggtattatttactcagtaaaagaggaaataagtttcagggaaaataatgtagtggaggaaggctactgtgattagaacacagggatcaagggagagagaactagaaggtgaagtaaaggaggaaggtagacacataatagttggtcataatgaatgtttagaaagtcattataattgcaaatgcaaacaaatggaggagtttaagcagggcagtgacacaatcagatgcacatttgagaaagttttctgtcttctgtgtggaggataaaatgcagttgtgaaaaactaaagagagaatatttgtataaagttgtatatacttactatgagttgtgtattttgtacccaagtgggcatgttgaaaagacgattgaaatagaagtccataactcatgggagagatgaggagtagagataaagaattatgtgtcagatagatggtatttaaaataaaaatattaatggaaattatgatgatagatatttagttatgcatatcttcttctcgccagcctctgtgcaaactgctttataagcatcatctcatttatctctcaaaatgaccctaagggataggttctatttaatatccatcttaagataaatttaaactagagtaggagtaatttgaccatgatcacaaataataagtagtagagctatgatttgaataaatgccagtctgactaaaagctttctttttcaattatgtgactttttaaaaaacatcaaatcacctctcccaagtcacagaattaaaaatgtggctttctaacagaagataactatttaagtctgtcactatgttgtcttaaacatttaacttatgccatatcacacaagaatgcaaatcttcatttgaattattttgtattaagagaataatagttcctccatcatataaatttatgttatattaaaaaaaaaaaaaaagtttatggtgaataatcagcatctgagcatggcttttcagttactgaaagatcccgctggaagccatagcatataatcaaacatgctgctgctgaccaggaggagtgactgcataatagctgcaaggctatggctcttggtctttaattctttggataaatgctgctacaaggaagaaaagtgaggatacaaacctctctaaacaggatgcttttcttttgaaatctgcagggcccctatgtctcccaggtttgaaattccttctctaagcaggagtaatgcttttttaaaaaggtatcttcttgtatattttaatgggcctgatattgcagctccaaatatttttaaaaaaggaatctttggcagttcttatggatgctaaactgaataaatgcagtttctacagtacaaagtatacaattatatttccattctgagaaacatatgttactaataaaaactctttcacaaaatcagtgattttttttttaaaaaaaggactcattttctaataacaagaaaaataacctgatatgtcaaaaatggtttccatttgttgtattgcagaacaattgcttttatttcagtttatgacagaaaataaagtatttcagttctatttttgcattccatgatgcaatttttcatacataatttttataagcaatgtataagttcttaaattattttttagagaaatattgtacaataatttgttaatcgtgggaagggaaaattaaaccatcatcacccatttacgctataattcgagcatgaaatggcagcatagtgttcggaaaatactgtaggcttggaactagaaatacctgaaataaaactttaccttcattatttactaactgt

SEQ ID NO: 461019 - DNA, 744 bp, Homo sapiens
ttgataactttttctaggtttgagatgttctctgtaactatccttttaaataaactctccaccctaatctctctctctctctgtctctcctctttaaggccaggtcatactttggtagatgcaaagcatggagttgagataaccagtgatggcatggaaactattttcattgactcagtagaggattctgagccagaggaggaagaggaaggaaagggctctgaaataggaaagaaaaggaagcaaaagaaacccaaattgaaaaacttgtgcgctactggtgttatggaaaatccttatgaaaagctagaaaataataaacaatgcccaataatgattgtacttttcccagttgagcatattgccacaatgaatgagattgaggttctctcaacaaaaatggatgcaatgctgcttggtgaaaacttagtgtatcccacagcaagcaatttgaaatattttactaactcttctttagctctttttcaggaggagattgagaggcttacggagtttgtgcaagtgtctgaatgcatgcagcgggtgctttgcgaggtacagatccgctgaagtacttattccattttctctgtggtgtgcatttctgatgtgaggctttcacgtgggcatcagtgtcctgtccggctcacccggaggaaaccaacctttcaaagttactcttaacagctgttcattgaattgcttctgtgggccaagcacagtgctagccgctgagggtagact

SEQ ID NO: 461020 - DNA, 505 bp, Homo sapiens
agtgagatcttcaaatttcctgtcgtctgtgttctcatgttctccccttatctgagattaagaaacgcacctgcatgtagtgttttcatttggtgatcaggactgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtgggtgccacgaggcccctgcgctggccttcacacagaagaccatcgaccgcttggcggtaaacccacccacgtcaatgtgtctgttgtcatggcggaggcggacggcacctgctactgagccgcccgcctgtccccacccctgaataaactccatgctccccta

SEQ ID NO: 461021 - DNA, 909 bp, Homo sapiens
agtgagatcttcaaatttcctgtcgtctgtgttctcatgttctccccttatctgagattaagaaacgcacctgcatgtagtgttttcatttggtgatcaggactgaacagagagaactcaccatggagtttgggctgagctggctttttcttgtggctattttaaaaggtgtccagtgtgaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacacagtgaggggaagtcattgtgagcccagacacaaacctccctgcaggaacgatgggggggaaatcagcggcagggggcgctcaggacccgctgatcagagtcatccgcagaggcaggtgcagatggaggctgtttcctgtcaggatggtccccttggtccacattccagggctcaaggcattttcttggagctcagtgattggagcctcttagaaagagattagaaggtggggacctcacggattttttaaaaagttagagaacggttgtcatcacttttttaaacgctgagagtcatttgttatctaatatataacccatcatgaggaatatctctagtgtgcttgggaagcatgcatattacgctgctgttggttggaatgttccgtagatgtctgttagggcagtttgttcgagagtgcttgagtccac

SEQ ID NO: 461022 - DNA, 997 bp, Homo sapiens
ttcagagccaagaagacttggtgaagaggtggcagagcagaatgagtagtggaaggaaggagagccaagaggaacgcgggaaagagatgtccaagtaccagggacatgtttgccaggcacgcactttggcccagcaggatactaggcgtggtggagatcctgagaagtgtgaactctgtctctccctgaaaggatttagtttacaatctattcatttcctggaaaggctttcttcttcttcttcttcttcttcttcttcttcttcttcttcttcttcttcttcttcttcttcttcttcctcttcctcttcctcttcctcttcttcttcttcttcttcttcttcttgttcttcttcttcttcttcttcttcaggaacggcagaggtagttagtaaggaagaaatcaaagatgacctcactctccaaaatttcaacatttatcatgcctgtggaaatgctttatcaccgtaaattcaccatattttacagatgactacctcatcttcctccaaaatgaaacctgcctcgtacaacaggtatttactgaccaccccttttgtgttaggcgttgggctttggatgcttaaacatagaaaggccgataacatagagacgttgtccttgcctagtttacagtggaatgagcagcactgccacgttatgatacagtgtgatgatacagtgtgttctatctggttaagatacaaagtgctaggccctagacagagggtctcctgaatcccctggctctgtgaacactggcatcattcttcttctcactccagcacaaaggcttagttatcagcaattttgttctgtcctccccaactcaccctttgatattcaattagtctgtaactttcctgacgttcttcagattaccccttttgcttacttctatcacagacctgaacccagggccttaatacctcctacttgggctaagttccttgctttctaagctgatttcttcacccctgagctgacttccttcaaag

SEQ ID NO: 461023 - DNA, 1221 bp, Homo sapiens
tttttaggctgagaggaagcatgtccagggctgacacgagaacctcctccctaagccctcccctcatctccctcctctcaggggtccctggaatgcctccatcccttattgtctgtccttaaaatcttaaagggaaaccaggaaggagagaaggagagagactatgggaatctcatccctggttctgattaagcttcaattagaaataaaatatgtcaatcactcctcctggaaggggttcctgctgtcggggctggttatgcaaagcactccaaggggaatacaggaagggggaggtggggtctacctagaaaacaacatggaaggaccagagggcaggcgcaacggaagtcactcacctgtcccaggccaagaggtctccacaccaggctctgttcttctggcagtgcccctgaccttttgtgtcctggaatacagcagaagaacaggatggcatggccctgctggacacagtacttgggaaaagaccacagactcaactgcttgctccacagcacgcacaagggccactgccaaaaatataattacccagaaatgtggaaccgagacaatgcagcagaggggactgagcagggacagtgggggagggacagagaggctagaggaagtagggctggtcctgagggacggatagagtccttctcagtggcccagtgagctgcggctggggaataagaggccccaggcaccaaggaagatggatctgcaaactagaagcttctaaggaagttggcttgactctctaacctttctggaaagagagaagccctttccatcctgcaaaattgtgaatggtcactttgcaatggaagaatcaggccgtcttccccaaacagaagcagaggagcaacccacccagctctcctctgcccagtccgtgttaggcaaaactaacctccctgatcctcagaggggatgggaacaaaaggtgggctacaagctcatctgtggagaaactacagcggaatatttgctgagatctttgacccagaggcttttgtgcaactgctaagctcatttcaggtcacgtgacactcttgtgccagtcctcactggtgtgatagttacagaaaagctggcattcgtctttgctcgaacaatgccccatcaacgtacaatatagaataaatgattattaatgacaagttttggggtatctctgaattgctatgactatttccaaccctgagaatgtgtcct

SEQ ID NO: 461024 - DNA, 1114 bp, Homo sapiens
aatcatgcacagcctggggcaagaacgcgctatggccgccccaactcggatgctctgtcgggatctctggctgctcctgccgtctcagcccggaggctccacttcaggcagcctggccaccctcccttcctctctgtttcccactatagcatgctttccttttttttgtttgttaaactttgcggcactccccgcatactgtagatccacgtctgtttccctgtttgacttccttcaggagggcaagggacttagggacccggtgcctagcacagtgccttgcccagagtcagggatcagcaaatggtgaatgagtgaatgaatgaatgaatgagtgagtgaacccgagtggtcatctagtcctgtctgcaggtgaggaaatcgaagcccggagaggggaaattctttgcccaagatcacatgattactacttacagatgtcctttattcaatgtaagctcacgttttcttgattttagcaatacttgtaataatttttaaaatataaatatatatgaaataaaagttcatcattgattgactatttcctatgtggcgactcctctgcttggcactcgacaacactcttggccactgtgtcatggttcccaaacttgtctgcacattagtcccctggggagctttaaaaatacaccccagggattgggatttagctggtctttggtgtgggctgcgctttggcatttttgagagatcccctggttctcatgtgcagacaagttctgagacccagtgtattacactgccctgcctcattcaccagggcagggggacattcacattcagtatcagccagggccgtccttttgggtcacttaattttcacaacgacacagtgaggcactgctctcctcattcccattttacagatgggatgccgagtttcggtggtcggccaggcccatgcggtggtggagtgaggactggaacagtggcatgtgtgactcagagacctggacctctgaccggctgcactgtgcactctgcagccccgcgggcctgacaatgtcccgcctgcctgtgagggcccagtgtacagaagatcacgcctggctcttcttctgtttcttgctgtcacccaggttctctcact

SEQ ID NO: 461025 - DNA, 979 bp, Homo sapiens
ttagagccagtgaggagcatatccccctgccccaagctccacccccgagcagctgggggtgggctggcgcaacgtgtggagaagcgaaccagcattcaggccaggacctgggctggaatggactgggctcgggtggcaagggggccatctggacaaagaccgtggccctgaatctgcctcccctgagcctggaacggaggtggagaccccgaggcagcaacagggagaagaaatagagacgctgaggcagagagaccagaagactcagagacggggagactaagagacagacccagcaacaggcggcctcacgggggcccgcggcgacccggagagggcgaggcaccgggacacagacccgggccgagaggagcccccgcgaggcgcagggccgtggcgcgcgggcgcagggtccccggcggggccagggtggccacactcgccgggcgccccctcccgggccgctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgcgggctcctcgcgttgaccttctgcctgttggccgcgcgcggtaagggcgggcgcccggagaggcaggagcgactgcggagtgctggtgcgcccgcgccctggtctgcatcgggctgcggggctggctcaagccggagtcccgagcaagtgcgggggctgcgcgtccaggtgcccgcgatgcctgcgcgggggtctgcgagctgcggccggggggcgtttgtggggcgtgcttgtccgcagtgggtgtgtgcctttggttcgcagagtctggagtc

SEQ ID NO: 461026 - DNA, 1853 bp, Homo sapiens
  misc_feature (1519)..(1519): n is a, c, g, or t
  misc_feature (1524)..(1524): n is a, c, g, or t
  misc_feature (1526)..(1527): n is a, c, g, or t
ttagagccagtgaggagcatatccccctgccccaagctccacccccgagcagctgggggtgggctggcgcaacgtgtggagaagcgaaccagcattcaggccaggacctgggctggaatggactgggctcgggtggcaagggggccatctggacaaagaccgtggccctgaatctgcctcccctgagcctggaacggaggtggagaccccgaggcagcaacagggagaagaaatagagacgctgaggcagagagaccagaagactcagagacggggagactaagagacagacccagcaacaggcggcctcacgggggcccgcggcgacccggagagggcgaggcaccgggacacagacccgggccgagaggagcccccgcgaggcgcagggccgtggcgcgcgggcgcagggtccccggcggggccagggtggccacactcgccgggcgccccctcccgggccgctcgcccaagatggcgatggaggggcgggtgaggcggcagcggccctggcccccgcgccggccccagctcgggcccgggcccccgaggccgcgcccccgcccgcggcgccgcgcctccccgggccactgacgcccggcgcgctctccccccgcggcggcggccgaagcacggggaggcggcggcggcggcggcggcccgagcccagccccatggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaaggtgntgtgntnntcagctctactacctatgactagttagaaatgcagaatctggggccctgcctcagtcctctacatcttaacaaggtcccctgctaatctgtgattcgtgtgcacagtttttctatgcctatgtacagttttctccctgaaattgagaacatgtgccgcatttatagttccaagtcctattttcattcaacagtataccataagcatttctctatctttaaaactttttcaaaaaattgtaatgactaatattccatactttaaatatagctataatgtaattcaccagttcctgctgttggatttttaagtcctttccagttatcc

SEQ ID NO: 461027 - DNA, 1562 bp, Homo sapiens
cgctcgggtccccccttccttgcccaaagaaacgatgacaacccacaaacgccacttcttccttcgcagtttgggaagccactgtaatgcgtcatttctgaggctcaggaaagacctttacccagaaggtgggggtgggggtgtcttgaatgtcccaaagcccaaggctggcccttatgtagagttgaggaagccctggccagggacaggggagtgcaagggaaggctcggtgacccaggcacatggtgcaaacctaggacctccacctcccagctctgtagccaggggcagctcactccaccctggtccctggagtgtgcttacaggcttccgtgttggggggctgcgaggcctgggcagcaaaccgccttgtactgcctctggcctgtggatagtagatgctcaataaacctctccttcctgtcagaaactcagtctccctatgtggatgacagcattttcctaaaggatctaaagttccatccaccttaaactctgcctgaagggaagactatgaaactagaaaagaaaatggtgtggatttgtgtgctactgcagacactgctgcgacatatattaaggagcatggaacggaaccgcgtggatgataaagtctgcgtggtgtttacaaaggaatattcataagcactttctgagaagccccgtgcagctgctaacagtgactgcctaggggaaaatggacttgaaggagtagaggccaacttttcattttatacctttctatactttttaggactaccacctatgtacgtgcattttatttttgttaaatgttcgcaggggatatctggcaggacaaggaactggctggaaaggggcgcgaggagatcttctgggtgacggagatccaggtggtggttactcagatgtattttatccttcaatgagaagtttatttcgaaaacgtcctgtgtctcttccaaagatagctccagctgggcaaagtggcagctctgtgggctccaacggaagaggccaaaaggcccatcctcctcctgtcccctgggttcaattcacagccctgcctgtctctagctgtgtgatcctggacgtgcctctctgcttcctcagctcctgcttcaagacaggcctaaccaaattttgagaagtccccagcagagctcccgaccctaatcagagaagaagaatgaatgttctgagtgggtaccacatggcaggtgctattctaaatactgaacagctgtgaacccatttaatccccgtaagaaactggtgagcttggtttcatttgactcaagaggcccagagacgaaagcaactggtccagggtcacacagccagcaggaagtggatcagggttggaacctgggcagtctggccctgaagcgctgcagaaagtattattttgggagcaaataggtaataggtggtgagagccacctaaaaatacccctcctctctggcccagtaaccacttctagaaatctgccctaaacaagtaactcaaataaagcgaaagctgagatacacgacggtcatggctgcgttatctataactgaggaaagctgggaacgaccc

SEQ ID NO: 461028 - DNA, 3006 bp, Homo sapiens
aggctgagtgttcttcgccattaactgtggccccgacaggcctgggttactgcggccaccgccacagcagccttggcgctatggaggagcccggggctacccctcagccttactgggggctggtcctggaggagccacgcagggttgtggcagcactgcctgaaggcaggagaccagattcgaatccttatggatttccatgggaattggtgatatgtgcagctgtccttggatttgttgctgttccctttttcttgtggagaagttttagatcggttaggagtcggctttatgtgggaagagagaaagagcttgctgtagcgctttctggactaattgaagaaaaatgtagactacttgaaaaatttagccttgttcaaaaagagtatgaaggctatgaagcagagtcacctttagaggatgccagctttgagaaggaggcaacagaagcacaaagtttggaggcaaactgtgaaaagctgaacaggtccaattctgaactggagcatgaaatactctgtctagaaaaggagttaaaagaagataaatctaaacattctgaacaagatgaggtgatggcggatatttccaaaaggatacagtctctagaagatgagtcaaaatccctaaaatcactgctagctgaagccaaaatgaccttcaagagatttcaaatgaatgaagaacaaatgaagatagcaatacaagatgctttgaatgaaaattctcaacttcaggaaagccagaaacagcttttgcaagaagctgaagtatggaaagaacaagtgagtgaacttaataaacagaaaataacatttgaagactccaaagtacacgcagaacaagttctaaatgataaagaaaatcacatcgagactctgactgaacgcttgctaaagatcaaagatcgggctgctatgctggaagaagacataacagatgatgaaaacttggaattagaaatgaacagtgaatcggaagatggtgcttacttagataatcctccaaaaggagctttgaagaaactgattcatactgctaagttaaatgcttctttaacaaccttagaaggagtaagaaaccaaatctatattcagttatctgaagttgataaaaccaaggaagagcttagagagcatattaaaaatcttcagacggaacaagcatctttgcagtcagaaaacacatattttgaaagtgagaatcagaagcttcaacagaaacttaaggtaatgactgaattatatcaagaaaatgaaatgaaactctacaggaaattaatagtagaggaaaataaccggctagagaaagagaaattttctaaagtagacgaaatgatcagccatgccactgaggagctggagacctacagaaagcgagccaaatatcttgaagaagaacttgagagaactattcatttttatcaagggaagattatataccatgagaaaaaagcacatgataattgtttggcagcacagaccgctgaaagaaacctcaatgatttaaggaaagaaaatgctcacaacagacaaaaattaattgaaacagactttaaaattaaatttttagaaaaagatccttatgcacttgatgttccaaacacagcatttggcagagagcattcctcatatggtccctcaccattgggtcggccttcatctgaaacgagagcttttctctatcctccaactttgtcggagggtccactcagactctcacctttccctccagggggaggaggaagaggcccaagaggcccagggaatcctctggaccaccagattaccagtgaaagaggagaatcaagctgtaataggtttactgatcctcacaaggctccttctgacactgggcccctgtcacctccgtgggaacaggaccgtaggatgatgtttcctccaccaggacaatcatatcctgattcagctcttcctccacaaaggcaagacagattttattctaattgtgctagacgctctggaccagcagaactcagaagttttaatatgccttctttggataaaatggatgggtcagtgcattcagaaatggaattcagtggaaatgataccaaagataatcttggtaatttaaatgtgcctgattcatctctccccgctgaaagtgaagcaactggccctggctttgttcctccacctcttgctccaatcagaggtccgttgtttccagtggatacgaggggcccgttcatgagaagaggacctcctttccctccacctcctccaggaaccatgtttggagcttctccagattattttccaccaagggatgtcccaggtccaccacgtgctccatttgcaatgagaaatgtctgtccactgaggggttttcctccttaccttcccccaagacctggattttccccccctacccgcacattctgaaggtagagtgagttccctttagggttgagtctgccttcaaatgagcctgctgctgaagatccagaaccatggcaagaaacttgacaatatttttgctctcttcaaaagtcattttgactattctcattttcagttgaagtaactgttgttacttcagtgattacacttttgctcatattcaaacttaatggaattataattctcaggatagtattttgtaaataaagatgatttaaatatgaatcttatgagtaaattatttccatatcattttattctagatagtataactattttaatttgtttaactaatccactattatataaacaacagtgggagatttatagatgtaatcttgcaggtggggaggctttacatttgaaaggccatggcattatgccaagaactgtatttactgtggttgtagacaaatgtgaaagtaactttatgcttaattaaataaattttacttgattaaaaaatatatataggttgcattattcttcagaacagtttgtatttatagaaaaagagaagacagcattgagttcccatatataaactctcctagtttctcctgttaacatcttacgttag

SEQ ID NO: 461029 - DNA, 1232 bp, Homo sapiens
ctgtgcgccaaaaagccgggcggcttcggagccagagcagcggctctgcggcgcaggcggcgggtcggggcagccttgaagccgggatccggcccgaaggggtctttttggagttcctgagctcagtgccccagaaggcacatacttcatatgaaatatgaaggatttcatactgcacaagaaaaagccttgagaaagacagaattgcttgtggaccgtgcgtgttccaccccacctgggccccagaccgtgctgatccttgatgagctctcggattccttgtgcagagtgaccgacttgtggaggggctagccagacagcacattcaagctgtatgtcccgggatgattccaatgaaggctcttcacaggaacacggagagaggccatgccctgaccctgcagacggagctgtggacaatgctgtttaaagccagcagtggtagctgaaaagtgagaggacgctgatgaagaacattgcagacacaaagaaaagaaaaaagtaaccaacatgtttcaaatgtttcaaacatatcaagtgagtcttctgaccattttgtgaagcaaatttttattaaacatattcactataaatgtcacaaagatcatgagaatgtcatggtaatgatgtattttacctttggacaactctctgtagacttcctgcggcaaagcttgtgcaaatagagacatatattaagaaaccaatttttatgcaaaattatcctaaacactagttttataaatcctgttgaaagaacactaagatgttgctttctaatggccatctataacattttctcaagaaatacaaaagaaaaaatagacaagaacatgtagctgttcaagcacatttcttttcttttttctttttttttttttttaaagatacaaggtcttggctgggcacggtggctcacacctgtaatcccagtactttgggaggcggagacaggcggatcacttgaggttgagtttgagaccagcctggccaacatggtgaaaccctgtctctactaaaaatgcaaaaattagccgggcatggtggtacacgcctgtaatcccagctacttgggaggctgaggcaggagaatcacttaacccagaaggtggaggttgcagtgagccaagatcgcactgctgcactccagaggcaggcagatcacctgaggtcaagagttcgagaccagcctggccaacatggtgaaaccccgtctctactaaaaatgcaaa

SEQ ID NO: 461030 - DNA, 553 bp, Homo sapiens
ctgtgcgccaaaaagccgggcggcttcggagccagagcagcggctctgcggcgcaggcggcgggtcggggcagccttgaagccgggatccggcccgaaggggtctttttggagttcctgagctcagtgccccagaaggcacatacttcatatgaaatatgaaggatttcatactgcacaagaaaaagccttgagaaagacagaattgcttgtggaccgtgcgtgttccaccccacctgggccccagaccgtgctgatccttgatgagctctcggattccttgtgcagagtgaccgacttggtaagatgctttgcctcagacttgaagctacctctctttcaacctgttaaaatttaagtgaaatttatcctttgttgtttactgttaatattagattataaagttaaaaatgtctgaaactatttgagatccattgggtataattttttgtgatgaaatacatcattaggaatggggaaaatgttataggaaaaggtgacatttagaacttgtactttaatatgtgtatttaataaaatatacctgtaatata

SEQ ID NO: 461031 - DNA, 1488 bp, Homo sapiens
  misc_feature (1)..(1): n is a, c, g, or t
  misc_feature (12)..(12): n is a, c, g, or t
nattcggcacgnggacttctttcacccagcataactcatccttttttggaaaatttccttccacccatacacctgatttgagcattaacacctttcagatgattatatgttcaccacaagcctcccgctcttaaggaaactgataaagtatcttattgtaaagggtttttctctggagtgaagttgcaggctctgggtagttctgttgtgctgggtttttgttctgtgcctcccgtatgtgcataggaaatgtgtctttgaatgatgggggagctgtggaacgcactgccaaaaggaggtttcataccctgttcacctgattgtgtcacagaaatcagaaaaggaaaatctgtgtcagtgaatttcactattcaagtacagtcaacccctccagattcgggcatctgtagagtcaaccaaccttggatcaaaaatatctggaaaaaaaaattgcatcggtactgaacacatacagacttttttccttgtcgctgttgcatgaaataatacagtgtaacagctatttacatattatttacattcattaggtattacaagtaatctagagatgattcagtgtaagggttgtgctgtgtgtcagttatatgatttgatgtatggagtgtgctgtgcgtcagttatatgcaagtactacaccattttatatcagagacttgagcatctgtggatttgggtatctgtaggaagatctaaccattgcccactgatactgaggggtgactgttggcatggctgtcacaaatcccagaattcactgtgtatttgttgtcttagtcttcatcttaatcagtattctaggatttttttctacatttttgcttgtggtcttcactaaaatattttaacttttctgccctgtatcttatcttattttgacatttttaatattatgtataatatctcattttgaaaacttaaaaaaaaaaaaaaactatgtgatttatatatgtagttctccgggtaaaaaagaacctttctcctttttgaatttttgagatgttacctaccagtaatgttggtactattataaggcaatcgtcttataaactttttcactaaatagtcattttgttttctttgttttcaacacagtttttacgtaacagaactgttttcctcatcactattagaaatcagttgttaatgtgcatgctagtgttttgaattttaatattgattataaattcacatgtagattagtaatttgtaaaaaaaaaaatgtaaatttatgtaactcatttttcagatactttggtactaatgttattttatcgttaccaattcttacaacaaatataccaaactatggatttaaatgttttggcattaaaaactatttgataataaaatcaggaaattttaccttgtggtgattttatttcatgttatagtcacacatcttcttggcaaataaaatatgtagtgttttgtagtttctctgctttttgttacaattgacatgaaaac

SEQ ID NO: 461032 - DNA, 1230 bp, Homo sapiens
  misc_feature (1)..(1): n is a, c, g, or t
  misc_feature (12)..(12): n is a, c, g, or t
nattcggcacgnggacttctttcacccagcataactcatccttttttggaaaatttccttccacccatacacctgatttgagcattaacacctttcagatgattatatgttcaccacaagcctcccgctcttaaggaaactgataaagtatcttattgtaaagggtttttctctggagtgaagttgcaggctctgggtagttctgttgtgctgggtttttgttctgtgcctcccgtatgtgcataggaaatgtgtctttgaatgatgggggagctgtggaacgcactgccaaaaggaggtttcataccctgttcacctgattgtgtcacagaaatcagaaaaggaaaatctgtgtcagtgaatttcactattcaagtacagtcaacccctccagattcgggcatctgtagagtcaaccaaccttggatcaaaaatatctggaaaaaaaaattgcatcggtactgaacacatacagacttttttccttgtcgctgttgcatgaaataatacagtgtaacagctatttacatattatttacattcattaggtattacaagtaatctagagatgattcagtgtaagggttgtgctgtgtgtcagttatatgatttgatgtatggagtgtgctgtgcgtcagttatatgcaagtactacaccattttatatcagagacttgagcatctgtggatttgggtatctgtaggaagatctaaccattgcccactgatactgaggggtgactgttggcatggctgtcacaaatcccagaattcactgtgtatttgttgtcttagtcttcatcttaatcagtattctaggatttttttctacatttttgcttgtggtcttcactaaaatattttaacttttctgccctgtatcttatcttattttgacatttttaatattatgtataatatctcattttgaaaacttaaaaaaaaaaaaaaactatgtgatttatatatgtagttctccgggtaaaaaagaacctttctcctttttgaatttttgagatgttacctaccagtaatgttggtactattataaggcaatcgtcttataaactttttcactaaatagtcattttgttttctttgttttcaacacagtttttacgtaacagaactgttttcctcatcactattagaaatcagttgttaatgtgcatgctagtgttttgaattttaatattgattataaattcacatgtagattagtaatttgta

SEQ ID NO: 461033 - DNA, 2275 bp, Homo sapiens
ttccttggctctccccacttacttcctgataacctgagttgaagtcggtgaagacattcatgatttaaacaccagatcctgaaaggcattaaatctactttgaaatgaatctgcaatcagtatttcaaagcttttctgacgttgctgaatttgaattgggatcacatgtgtttcctcatctaggacctggtgaacttccaacactatgttgaataggagtggtgagagagggcatccctgacatgggtgcaggctatgaagatgggaaaaggccgttgatcactctggcttcttcctgctgacagcggacatagtgggaatgggagtgaaccccaaggtgagagagtggaaccactttgcaactgtctgagcgtactcatgcagccctggcttttcagtaggcctacacagaaaatgtgagactgaaaacccctgcatccttgagctcatggacgatgtgctctatgaggcagtagaggagctccgcctggtactcgacactccacaaagcaactctccctttggggctgcagttggtgaacaaaaagaaactctcaaggatccaagatgatgctgataagacttattaaatttggagaaaccaaatttaacgtcactgaacccaaagaacccggagagtcagtggttataagaattccagtgattcaccaaggagacacttccaaggtttccatcgcctatggtgggcatttcttgtttactcaagaacctaccatctctcacaaaataatgtccactggaattcgattatcgacggcggcagagaaagcgtgggagcgacgctcttgctctggacgccgacgtgcccacgtcgaggccgcgcccagacccggaggcggggccgtcacgtggggcagcgtgggccgctgccttggaaacgcagagcgcgcgctccagggtctttttggagttcctgagctcagtgccccagaaggcacatacttcatatgaaatatgaaggatttcatactgcacaagaaaaagccttgagaaagacagaattgcttgtggaccgtgcgtgttccaccccacctgggccccagaccgtgctgatccttgatgagctctcggattccttgtgcagagtgaccgacttgaaatcagaaaaggaaaatctgtgtcagtgaatttcactattcaagtacagtcaacccctccagattcgggcatctgtagagtcaaccaaccttggatcaaaaatatctggaaaaaaaaattgcatcggtactgaacacatacagacttttttccttgtcgctgttgcatgaaataatacagtgtaacagctatttacatattatttacattcattaggtattacaagtaatctagagatgattcagtgtaagggttgtgctgtgtgtcagttatatgatttgatgtatggagtgtgctgtgcgtcagttatatgcaagtactacaccattttatatcagagacttgagcatctgtggatttgggtatctgtaggaagatctaaccattgcccactgatactgaggggtgactgttggcatggctgtcacaaatcccagaattcactgtgtatttgttgtcttagtcttcatcttaatcagtattctaggatttttttctacatttttgcttgtggtcttcactaaaatattttaacttttctgccctgtatcttatcttattttgacatttttaatattatgtataatatctcattttgaaaacttaaaaaaaaaaaaaaactatgtgatttatatatgtagttctccgggtaaaaaagaacctttctcctttttgaatttttgagatgttacctaccagtaatgttggtactattataaggcaatcgtcttataaactttttcactaaatagtcattttgttttctttgttttcaacacagtttttacgtaacagaactgttttcctcatcactattagaaatcagttgttaatgtgcatgctagtgttttgaattttaatattgattataaattcacatgtagattagtaatttgtaaaaaaaaaaatgtaaatttatgtaactcatttttcagatactttggtactaatgttattttatcgttaccaattcttacaacaaatataccaaactatggatttaaatgttttggcattaaaaactatttgataataaaatcaggaaattttaccttgtggtgattttatttcatgttatagtcacacatcttcttggcaaataaaatatgtagtgttttgtagtttctctgctttttgttacaattgacatgaaaac

SEQ ID NO: 461034 - DNA, 1587 bp, Homo sapiens
gaaaacggcaggtgattctgcatggaaggttccaagaaggaagaaacgtctccttattcccaggctacagcccacattgaaggtccaccattgaacaaaaagatgggagtaggtcaagaagttttctgcaactacagctttagaataaaaattgctgataaacagttcacccaggtgatggtgagagggtcacaagggcagttcccccacacaagctctcttgccttctgccatgtaagatatgactgtgctcctccttcaccttctgccatgattgtgaggcctccacagccatgtggaactggaagctgtttttccctctttggggtctcagagagattggtggcaaggactcctgggaagagaaaagctgaaggacactctggcaagaggtaccacctctcactggctgcccaagcaagattctatggcttggaataattctcagcgactcactcatcaaagggcatctatctagaagccctgctccttcagggacatctgaggttgatgagctgatccaataagccatcagagctggaatagtagtagttaacaatggctctctgcactctttttaaataactttgcttttcaggccaaggtgagagcctcgtgggaatttcacaaattttatagaagcagaggagtgctatttgagcaaggggcggataacacctacaatccactcaggatttccaagcatagccggatgcagaagtactcatacttcactacagaatcacctggggagcttttaaccttctgattctagtgtttccctctggcagatggagacagaaacttgactgggctcaggaatatgtgtttttaaaattctccagaagattttaatgcagtacaagtaagaagacaggactgcaattcacaagaacagtatatcctggtgattcctcagaacagaacagactcaaaaaaaaaaaaaaaagaagaagacaaaaacaaagataacatgaaaccagattccacaaccatgtttcaagtgacctatgtgagtcaggcccatgagacacatactacaccagtttcagtgaagcctcacaaaatttaggggggtagaggaaagggtcctatgcccatttcatagatgaacaaactaaggacttaatagatttcaacaatttgttcaaagtctctaccttaaaggattttggggttctggtttttgtttttacctgccctggtaactcttctaagaatgagccaagaagaagacaaccttctaagatacttttcctgccctccaagggctgtggagaatctgatagggttggagctgccctctcctcttcccagagacactgccccacaatcccatcaagtctgactggtaccaacgactccagggggcctctgccttcagaactgtataggcctgtgtgggcaccagtctttacatccatgttccctctccctcgaggacccaggttgacctgtccaagagctctctcatcatgctgaattttggtgacagcatagggtcacgaagcggattaccctagatttctcagagctggcccttgtgttctttctggaaggtgcttgtgtaatgacatggagagaggc

SEQ ID NO: 461035 - DNA, 607 bp, Homo sapiens
gaaaacggcaggtgattctgcatggaaggttccaagaaggaagaaacgtctccttattcccaggctacagcccacattgaaggtccaccattgaacaaaaagatgggagtaggtcaagaagttttctgcaactacagctttagaataaaaattgctgataaacagttcacccaggtgatggtgagagggtcacaagggcagttcccccacacaagctctcttgccttctgccatgtaagatatgactgtgctcctccttcaccttctgccatgattgtgaggcctccacagccatgtggaactggaagctgtttttccctctttggggtctcagagagattggtggcaaggactcctgggaagagaaaagctgaaggacactctggcaagaggaaaccccgagccaaacgtatggccacctctgaccactcgaccagcccagcatggtgtacatttctgggtagcttatcacgccttccaagcattgcctttatcttccttctccccatcaagcctgtattgttttccttttgaatcataagcacttttgttaaatacctcaaatctttcgagaacagcaaggagcaaaataaacttaacttctctg

SEQ ID NO: 461036 - DNA, 669 bp, Homo sapiens
gaaaacggcaggtgattctgcatggaaggttccaagaaggaagaaacgtctccttattcccaggctacagcccacattgaaggtccaccattgaacaaaaagatgggagtaggtcaagaagttttctgcaactacagctttagaataaaaattgctgataaacagttcacccaggtgatggtgagagggtcacaagggcagttcccccacacaagctctcttgccttctgccatgtaagatatgactgtgctcctccttcaccttctgccatgattgtgaggcctccacagccatgtggaactccatgagtatgactatgtgctgagtcctgtgagtcctcctactgaatcatcaaagccaggggggaagctgtttttccctctttggggtctcagagagattggtggcaaggactcctgggaagagaaaagctgaaggacactctggcaagaggaaaccccgagccaaacgtatggccacctctgaccactcgaccagcccagcatggtgtacatttctgggtagcttatcacgccttccaagcattgcctttatcttccttctccccatcaagcctgtattgttttccttttgaatcataagcacttttgttaaatacctcaaatctttcgagaacagcaaggagcaaaataaacttaacttctctg

SEQ ID NO: 461037 - DNA, 1188 bp, Homo sapiens
gaaaacggcaggtgattctgcatggaaggttccaagaaggaagaaacgtctccttattcccaggctacagcccacattgaaggtccaccattgaacaaaaagatgggagtaggtcaagaagttttctgcaactacagctttagaataaaaattgctgataaacagttcacccaggtgatggtgagagggtcacaagggcagttcccccacacaagctctcttgccttctgccatgtaagatatgactgtgctcctccttcaccttctgccatgattgtgaggcctccacagccatgtggaactggaagctgtttttccctctttggggtctcagagagattggtggcaaggactcctgggaagagaaaagctgaaggacactctggcaagagatggagacagaaacttgactgggctcaggaatatgtgtttttaaaattctccagaagattttaatgcagtacaagtaagaagacaggactgcaattcacaagaacagtatatcctggtgattcctcagaacagaacagactcaaaaaaaaaaaaaaaagaagaagacaaaaacaaagataacatgaaaccagattccacaaccatgtttcaagtgacctatgtgagtcaggcccatgagacacatactacaccagtttcagtgaagcctcacaaaatttaggggggtagaggaaagggtcctatgcccatttcatagatgaacaaactaaggacttaatagatttcaacaatttgttcaaagtctctaccttaaaggattttggggttctggtttttgtttttacctgccctggtaactcttctaagaatgagccaagaagaagacaaccttctaagatacttttcctgccctccaagggctgtggagaatctgatagggttggagctgccctctcctcttcccagagacactgccccacaatcccatcaagtctgactggtaccaacgactccagggggcctctgccttcagaactgtataggcctgtgtgggcaccagtctttacatccatgttccctctccctcgaggacccaggttgacctgtccaagagctctctcatcatgctgaattttggtgacagcatagggtcacgaagcggattaccctagatttctcagagctggcccttgtgttctttctggaaggtgcttgtgtaatgacatggagagaggc

SEQ ID NO: 461038 - DNA, 963 bp, Homo sapiens
  misc_feature (920)..(920): n is a, c, g, or t
gaaaacggcaggtgattctgcatggaaggttccaagaaggaagaaacgtctccttattcccaggctacagcccacattgaaggtccaccattgaacaaaaagatgggagtaggtcaagaagttttctgcaactacagctttagaataaaaattgctgataaacagttcacccaggtgatggtgagagggtcacaagggcagttcccccacacaagctctcttgccttctgccatgtaagatatgactgtgctcctccttcaccttctgccatgattgtgaggcctccacagccatgtggaactggaagctgtttttccctctttggggtctcagagagattggtggcaaggactcctgggaagagaaaagctgaaggacactctggcaagaggccaaggtgagagcctcgtgggaatttcacaaattttatagaagcagaggagtgctatttgagcaaggggcggataacacctacaatccactcaggatttccaagcatagccggatgcagaagtactcatacttcactacagaatcacctggggagcttttaaccttctgattctagtgtttccctctggcagatggagacagaaacttgactgggctcaggaatatgtgtttttaaaattctccagaagattttaatgcagtacaagtaagaagacaggactgcaattcacaagaacagtatatcctggtgattcctcagaacagaacagactcaaaaaaaaaaaaaaaagaagaagaaaaaacttgggggttttatgggggggggggaaaaaggggtatggaggggccagttggtcatagctgttccctgacccagtttttttgtccaaggtggtaaatcgcggggtctccctatagggagcgtataaattcgataagccggtacctgctatgttgtggcaaaaancagaaaaaagaaacaggagaggctacattgtcaaaagtggtaa

SEQ ID NO: 461039 - DNA, 1231 bp, Homo sapiens
tctggagagaagatcaaaccagtcacaacattcccgtaagccaaagcctaatccagggcaaggtcctaactctcttcaaacaataaagcctgaatgacagcaaaactgtttatagcacagtttactgaatattttaaactccctgttaagacctactgttcagaacaaaagcttcctttcaaaatactactgctcattgacaatgcacctagtcactcaaaagccttgatggagattgtacaggagattaatgttgttttcatgcctgttaacacaacatgcattctgcagcccatcagtcagggaatcatttcaaatttgaagtcttatcctttaagacctacattttatgtcattaagaatatgcctgattcatgggaggaagtcaagatgtccacattaactgcaatttggaagaagttggttccaatccttatggatgactttgaggggttcagaacttcagtgaaggaagtaactactgattgggttgaaaaagcaagagaattagaattagaagtggagcctgaaaatgtgactgaattgttacaatctcatgataaaacttgaacaaatgagaaagcatttcttatggatgagcaaagaaagtgtttttttgagatggaatctactcctgatggaagatgctagcaagtgatccaacagagagcactgacacatgaaaacaccactgtcttttatgacctagtcccagaagtcacactttgtcccttctgcaataccacactggttacacaggtcagctctattcactgacagagggaacaacaagggcatgaaccccaagaggcaaggatgacaggagccatcttgaaggctggcgaccacagatccacacctaactccaaaccaccaaattactcggagtgtgtgtcgggttgcagaaaatgaaatgaccataataactccaagacagagcagaaggttcatctgagtcataccaaataacttcattgctgctaaagtaaaatttgaaaatgattgaagtgatttttatgatcagccttttggaagtcattcaaaagtgctgcaatgctacttcaaagaagataattcaaatttaaatgtcactcttcagtgttgtttatcaacagctgagtattaaaattggtgagcttgatttgtgttatttcacttcaccagcttataatttaaacactcttatacttattatttgaataaatggaataaacacaagtcaaactttggt

SEQ ID NO: 461040 - DNA, 1089 bp, Homo sapiens
tctggagagaagatcaaaccagtcacaacattcccgtaagccaaagcctaatccagggcaaggtcctaactctcttcaaacaataaagcctgaatgacagcaaaactgtttatagcacagtttactgaatattttaaactccctgttaagacctactgttcagaacaaaagcttcctttcaaaatactactgctcattgacaatgcacctagtcactcaaaagccttgatggagattgtacaggagattaatgttgttttcatgcctgttaacacaacatgcattctgcagcccatcagtcagggaatcatttcaaatttgaagtcttatcctttaagacctacattttatgtcattaagaatatgcctgattcatgggaggaagtcaagatgtccacattaactgcaatttggaagaagttggttccaatccttatggatgactttgaggggttcagaacttcagtgaaggaagtaactactgattgggttgaaaaagcaagagaattagaattagaagtggagcctgaaaatgtgactgaattgttacaatctcatgataaaacttgaacaaatgagaaagcatttcttatggatgagcaaagaaagtgtttttttgagatggaatctactcctgatggaagatgctagcaagtgatccaacagagagcactgacacatgaaaacaccactgtcttttatgacctagtcccagaagtcacactttgtcccttctgcaataccacactggttacacaggtcagctctattcactgacagagggaacaacaagggcatgaaccccaagaggcaaggatgacaggagccatcttgaaggctggcgaccacagatccacacctaactccaaaccaccaaattactcggagtgtgtgtcggcctgcccacggtgcggtgagcccatgtgactagaccccggacgatggactaagagggaagaggacgtgcctaagttccgggctgaggccttaagaacccatgcactcttctcctgttacttttccctgcggcaacaagcaaggagtcctcattccagggagtgtgaccgcatcgtggtgctaattcccttc

SEQ ID NO: 461041 - DNA, 1041 bp, Homo sapiens
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcgcaagggctgggctgctttgtaccttgcccttcccacttgattgttttttcggttgatgtttattaatttgtttttatttatgtattttgttgttgttgtt

SEQ ID NO: 461042 - DNA, 3427 bp, Homo sapiens
ggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggacacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagaggaaaaagcattttcattttgactttaccctaagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcag

SEQ ID NO: 461043 - DNA, 1537 bp, Homo sapiens
agagaaagcaagagaaggtggatgagaagggaggcaggggaactgcaagccttcagtccttgtaccttttaggatgtagggacacccagagaacagccctcaataagatctggaaagaagagctgtcaccacagacttagaaagtaggtgtatttttttacaaatccaaaattcctatatcccataatcataggtgtgtgttgagcagggcagatttcctttcctaatctctgttttctctttcagaataataggttattcccctgtcctgagttctgcttgaaaaactgagagttctagaactttgcaaaagctcctctattgttccaagatgagcatttttctggggtgaactgggcagaggtttgactggcaagcagctctgggtgtacatttcatccaagagtctcatggtggtcgaaggagatccccagatgcaaaatcaaagttgcttggatttccatttcttccccatctaggaaaagggcaatggaatcaaagcctttaaaaaatgtagtaagagaaagactctctaattgatcagaaccttctggcaaccaggactttggcccatctactgaaaaatactttatcagtgtctttagtaaaggcccccaagatgcacaatacatttttggttgttgaaatagagtgtcttctaagtcatcaagtaaaagagaaattctgctcagaagacttttggatagtacccaacatttggtgaggcttactatattacatgcattacctcgctaaatcaccacattagaacacttacagctacctcaggcctgatcccagctgccagactccaacggagtcagatcctcaaattgccaggagatcgctatccaaactgtcaccccctgatcagaaaagaaggagttatgtaagtaactgacagcacctgagcgatctctcatttggattaaatcaagttctttaaatatttataaaaatgacacctgtcaatcaggcaggacatccccttgggtcgtccagtccaagaaaactcactggcttcttgaaaagccaaagagaacaagagaaaagggatgaggagagtgaacagaggggaggagggaacaataggaaagggaggagagtattgggggagatgctgctgacaggtggtgtcctagcacagttccctggagaatggcctgaggaaaagcttatgggctggggctttactggagcacacaacaccaggacagcaaaaatgaaatgcctttccactcagatgaggctgactcctacaccaccctacttcatgccctggctgcagagctgggcacatgttccagtaactgtgcatgtagtggtccttaataagtgcttactcacagtcagcaccatcagcccagggactattccaagcaaaattgtgaagatgatgggaagccatttctgtgcagggagacccgaaaagaacaacaagatatcaatcaactttgagcatcaccaggagggtgaaaacaatggtactgaattgcaaattgtaggactgcagaaataaagttctgttcacaaaaaa

SEQ ID NO: 461044 - DNA, 881 bp, Homo sapiens
agagaaagcaagagaaggtggatgagaagggaggcaggggaactgcaagccttcagtccttgtaccttttaggatgtagggacacccagagaacagccctcaataagatctggaaagaagagctgtcaccacagacttagaaagtaggtgtatttttttacaaatccaaaattcctatatcccataatcataggtgtgtgttgagcagggcagatttcctttcctaatctctgttttctctttcagaataataggttattcccctgtcctgagttctgcttgaaaaactgagagttctagaactttgcaaaagctcctctattgttccaagatgagcatttttctggggtgaactgggcagaggtttgactggcaagcagctctgggtgtacatttcatccaagagtctcatggtggtcgaaggagatccccagatgcaaaatcaaagttgcttggatttccatttcttccccatctaggaaaagggcaatggaatcaaagcctttaaaaaatgtagtaagagaaagactctctaattgatcagaaccttctggcaaccaggactttggcccatctactgaaaaatactttatcagtgtctttagtaaaggcccccaagatgcacaatacatttttggttgttgaaatagagtgtcttctaagtcatcaagtaaaagagaaattctgctcagaagacttttggatagtacccaacatttggtgaggcttactatattacatgcattacctcgctaaatcaccacattagaacacttacaggttatgacaaaacaagaaggcccttacaagatgccagcaccttgatcttgaacttcccagactccagaactgtaagccaataaatttctgttcttcataaa

SEQ ID NO: 461045 - DNA, 925 bp, Homo sapiens
agagaaagcaagagaaggtggatgagaagggaggcaggggaactgcaagccttcagtccttgtaccttttaggatgtagggacacccagagaacagccctcaataagatctggaaagaagagctgtcaccacagacttagaaagtaggtgtatttttttacaaatccaaaattcctatatcccataatcataggtgtgtgttgagcagggcagatttcctttcctaatctctgttttctctttcagaataataggttattcccctgtcctgagttctgcttgaaaaactgagagttctagaactttgcaaaagctcctctattgttccaagatgagcatttttctggggtgaactgggcagaggtttgactggcaagcagctctgggtgtacatttcatccaagagtctcatggtggtcgaaggagatccccagatgcaaaatcaaagttgcttggatttccatttcttccccatctaggaaaagggcaatggaatcaaagcctttaaaaaatgtagtaagagaaagactctctaattgatcagaaccttctggcaaccaggactttggcccatctactgaaaaatactttatcagtgtctttagtaaaggcccccaagatgcacaatacatttttggttgttgaaatagagtgtcttctaagtcatcaagtaaaagagaaattctgctcagaagacttttggatagtacccaacatttggtgaggcttactatattacatgcattacctcgctaaatcaccacattagaacacttacaggatgatgggaagccatttctgtgcagggagacccgaaaagaacaacaagatatcaatcaactttgagcatcaccaggagggtgaaaacaatggtactgaattgcaaattgtaggactgcagaaataaagttctgttcacaaaaaa

SEQ ID NO: 461046 - DNA, 1265 bp, Homo sapiens
agagaaagcaagagaaggtggatgagaagggaggcaggggaactgcaagccttcagtccttgtaccttttaggatgtagggacacccagagaacagccctcaataagatctggaaagaagagctgtcaccacagacttagaaagtaggtgtatttttttacaaatccaaaattcctatatcccataatcataggtgtgtgttgagcagggcagatttcctttcctaatctctgttttctctttcagaataataggttattcccctgtcctgagttctgcttgaaaaactgagagttctagaactttgcaaaagctcctctattgttccaagatgagcatttttctggggtgaactgggcagaggtttgactggcaagcagctctgggtgtacatttcatccaagagtctcatggtggtcgaaggagatccccagatgcaaaatcaaagttgcttggatttccatttcttccccatctaggaaaagggcaatggaatcaaagcctttaaaaaatgtagtaagagaaagactctctaattgatcagaaccttctggcaaccaggactttggcccatctactgaaaaatactttatcagtgtctttagtaaaggcccccaagatgcacaatacatttttggttgttgaaatagagtgtcttctaagtcatcaagtaaaagagaaattctgctcagaagacttttggatagtacccaacatttggtgaggcttactatattacatgcattacctcgctaaatcaccacattagaacacttacaggccgactgtgctgctttgtctgaatctagaacaaaggatcggcccttaaggaggctgatgcgatgttaaagcccatcactctaaaattgacaccacacctgggaagagcaggcagcaccatcactgtctttcctgttcaagaatgacacctgtcaatcaggtttctgacacatccatcacttgttatgtttagaaagggtggaccatccatggccttcatatcaacgtatgaaaaccaacataccctccagcaagctctacggctatatgacccttatccacagcaagtccctggggaaaattattccttaacatggtgttgaatgctgacaaggtatatcagtcagctttggctagcaaagtgaaggctctgtacctctgctccacatgttttctgcaacctgagatgcaggtctcatggttcagggagaagagcactgtgaatgaaccatacaaagtcttttaaaacttctgcacacagatat

SEQ ID NO: 461047 - DNA, 207 bp, Homo sapiens
acatcacctcttggattccagttcccaccaggcagtccctaccatggctccagctctcacaggatgatgggaagccatttctgtgcagggagacccgaaaagaacaacaagatatcaatcaactttgagcatcaccaggagggtgaaaacaatggtactgaattgcaaattgtaggactgcagaaataaagttctgttcacaaaaaa

SEQ ID NO: 461048 - DNA, 1679 bp, Homo sapiens
gtaagggacatggaacactgcgaccacattactatgccctcacctgcctgggcagcagggatctcaggcctcatcagagcagaacgatctggaagttgctggccacatgccactgattttctctcccaggagcaacccagcagtctttccttgagggagaaatttaattacaagaaatttgcaaacatatttgggaagaaagtctgctggagccgaggggcaacagtcgagctgattatttggtctgcaatggccctaggtcagagcaacaggcatgctcgacaatcctctgctggaaaattccaaactcctcaggcccgctttccatataaggagcctgtgtgcaagtgtgtatgttccagaatatttgtacatggaaatgagagtgtgtgtgagaagacccagttcctgaccaccgatgctttgctacgctaggctggaaaatgcctccctctgcccttgagaagggggtctgaatgttttgcgggactgacaccgcagcaacatgccggtgtgtttcacgctgctgcctcctgtttcccttgaagctttcaccagaccctggatttctttttcacttcctgttctgagccatcgccgggcactcattacccaccagctgtgtcccagctgccgcattctacactagaggtggcgccctgcacccggcggaaatgaagagaatcagactacccaccttggattctgatatgaaagatttaggataaaagagctactccatcagcctggaaagatgactcactggcaaactcttagataaagctaaacttcacaccaaactgcaagagagtctaagaatgaagagaaaactgctttggcaagcaactacctagtctctgacacagtccacctttttggtcagccaatatccagctccgccttgtcttcttacacaaagcccaggcaaagcccaggattgctaactgttgtacaaacctgttggtcaggcctagatggaagctttcaaccccatttcaagtcagctggcttatccaaccctgaaaggtctgtgatctctcagttctttttataaacaggcctctgcttgcaaatggccaattcttgcctgagctcatctctttcttgtaatactttatgaaaggcagccagtagtaactaatgcataaatttttccaaccaactggcccaaaggtcagtagacctttttaccaaatgtttcgcaatgtatagcatgaatctccatctttctcctctctgttatcaggttcctcagtgcccaaccattatgtcaatgccttttaccttaatttttttcttatggcaacattttcttctggaattatttctgtactgtagcaaatgccctaaactgtgtaaaacagtttgaagacactatttttttttctatttttatcatttgttcctcggtctactcaatacgctccctgcttaaaactcccctagtgattttctgttgggtttaaaatagagtctaaactctttaccatggattacaagcttctctgttaactggttgtaacctgcatttccagcctcctttggcgccactcttgtcccaccaactatatcacatttcctttggaacattttctgcttcttgaacttgcccaggtccttgctgttagctggtccctttgcctatgatgatcttccttcttagcatcacttgaactgca

SEQ ID NO: 461049 - DNA, 5125 bp, Homo sapiens
ctctctcttttggaaaaatgcagacaaacacaaaaagagaaccccctctttcctccctctctgcaacctcccctcctctctgcaacccgctcctcccctcctttcagtagccccatctttccctcctctctgcgccccctcctcccttcctctctgcagccccctcctcccctgctcctgccggaagagcagcaagacctgcagtgacgtcatgtctgtggacgcccaaaccctgaagaagaagatgggcaagctggcctgtgacccggccgcccactccatcctcagcagcctgctgctctacgtcacgggccgcgcagaccggcccccggggacagaggccggggggagcaggcccagccaccagccccagacccaggaggccacccagcggcccacgcgcttccagctcctgcaggccaagttcctgggcactggccgggagcgctacctcaagaggaccagggaggtgggccggctgatctccaaggacaagcaggggccgggtgggggcctcgtgggtgccaccatcaacaagctcctggagaagaccaaggagccggccccaaagccctgcctcagcgagaagccccgctggggccacccggccgggaagagcaccgtgaaaaacatcctgaagatattcttggccgccgaggagaaggaggcgaaggagaaagaagcacgcgagaagccccctgtggagcggcccaaagccgccaggggcctcttgccgaagatcatgggcaagagctcggtgctgtccaagctgcgggagaagttcgagcagaacagctgcctgtgctccgaggccagtgcgctgaggctgcacacgcaggagcggaagaagaggaacctgcagaggaagaggatgcaccggccggaggtgcgcgtgctgcacacggccaccatggccagcacctgcgtcaagatgccccctgcccgctttctggcctgcacggctgagcccctgccggccctcagcatcgccaccgtcgtctgtggccccaggagctggctgtcccactgcaccaaaatcagccactcggaggcaaggcgtccacccagaggagaagccagcgtgccccctagtgccagggagacggggcccagtgggaacaaagcagtgggaaaggggcccctggaggaggagccccaaagacagccaaggccctcgaagcccgtgacaccccaggtgatggctcagagggacggccacgctgtcccctcgctggccttctcttgtgctccctgcacaggtggagtccttcctggccttgtgcctgcatcatccccactgggaccggccagcccttggggcaccggatcagccggaggtgatgggactgcagaccccaccgcagagagcaccgcaggaggcgtccaggaggtgaggggagccaggctcacgtggcctcctgggcccccaggcgagtgtgcaggggagggccctgaaatcaccatgactgtttgcagttcagaggatgaaagggaaggagcaggcttcccagacccagggagagaccccctctttgccacccagaagtatttcccagaacagaaggtgccggagcacatcccacccctgaacgctccatcggtccaggctgctcggagaacacagcctgccacggagcctccacggataactgtccaaattccagttgtccatgaaatgccagcccctcccaccaggctgcaaaatatgtcaagtggtgaaaacaaaccttgtatttgtggaggagagaatgtggttgaaaatgcccacacagaatttcccaccgtgactgagaacagaaggggtcaccgagccccagtggaactgagcaagctttcagggatgcaggcgggactcagcgcctcttcgccgcaggggccacgggcagctccgcgtctggcagcagcaagaggggctgtgggcgccgaccacagtgtcccagagacacttctgacacagagactccagacagatcctgctggcgggaaggaaaacaaaggcagctttgagaattcacacggtcccaggaatcctgacgatatttcaggagagaggacctctgagctcagagatgtgaagcatccgttgccggaatctaatgaaatatcaatgcagaagaagggctccgcaacaaatgatcctgcagcctcacaaaaccttctgaggggaaacaccagccatgcctccagcagccagcaagtgccgtccccgactgggagaaacccaacaggagcccccacgtcactggcggcatcatccaaggggcgtacggggcctgagggtgtcaccccgatgggcatgacagtgcccggtgcgctggaggaatgcagaaggccgctgctaatagagtcttctcagcccctgaaggctgccgaggaaatcaccagccatgatgttcgcgagaacccactgtcctcattaaatgaaccacccaaaccaggtatgaaagcctgtggggcgatggcagctgcagggagcgttgcgagccgcgccacgcctgcaccagcgccaggcagcacccagagccctggagaccgcacagcgggagagccagagacgctgggccagtggggaagcagagccttgtccgaaagccaccccagaggagaggctctccctcgagaccctcacagccacggcctcctggcccctgggggatccttggagcccaagagtggagcagcagggaggagcctcctgagaggcgtggccctcgtccagcacccagaggacattgcgaccctcgcccgccacccggaggatgctgcggccctcgcccggcacccagaggcggcccgattatacatttcaaacacatcagcagccagcagacatacagcagctgtaggaggcagaaaggatgtggctgtggaaggaaaccttttgggtttcagcacagagtctggaattcctgcttctgatcatcctaggccacaggcaaggagcgtggcagagtcccccagctatggccctggcctcccgccgtcgcctcctgagaacccacaggcaaagggcagggagggcgtcaggtttccccgtggggcggagcctgaccatctgcttcccgcagtgcctcccgcggaggtggacatggggtgggtaggtggcacccaccagcggggccctccccatctacaggcacacctgccccctactgctggtgacacacaggcaaagctccgggccagtgtccccgagcctaggacgcaggcaggtgaatcccaggagcgtcccctgacacaggcggacctggggaggcaacagagtcaccaggcacaggaggagaccccccagcccggggatgcggggaagagggtggcgccgtcgggctcgaaggttgtgctgaacccagcaaaagagcctcagacatggtgggcacaggatctggccggggacaaagggatggccattggggttgggggcgcctgccagcgcagtgaccaaggtcagcagcatctgcagggaccctgggaggagcgggggcggagcacggcgtggggagagggcaccagggctgccaggaacccagctgtgcctccaggggagcccgaggggccgggaagcccggcagcccaaggacaggcccagaaacaggttcaggaatgggaccggggacaggttcagggacacgctcaagaacaggcccagtggcagacccagatagaggcccaggggcaggcacaggaacaggctcagggtgggacccagggacacagtcagggacaggcccagaaacagtttcagaattgggcccagggacaggctcagggacacgctcaagaacaggcccagtggcagacccagatagaggcccaggggcaggcacaggaaccagctcagggtggggcccagggacaggttcagggacaggcccagaaatgggctcaggggcagattcagggacaggcccagaaacaggttcaaggagaggttcagaaatgggcccaggaagaggctcagggacaggcccagtggcagacccagataaaggcccagaaatgggctcaggaacagacccagaaaggggctcaggaacgggttcagggtcaggcccagaaaggggctcaggaacgggcccaggaacaggctcaggagcagacccagatagaggctcagggtcaggcccagaagggggctcaggaacgggctcgggaacaggcccagaaaggggctcaggaacgggctcgggaacaggcccagaaaggggctcaggaacgggctcgggaacaggcccagaaaggggctcaggagcgggctcgggaacaggcccagaaaggggctcaggaacgggctcgggaacaggcccagaaaggggctcaggaacgggctcgggaacaggcccagaaaggggctcaggaacgggctcaggaacagggtcgggagcagacccacatagaggctcagggtcaggcccagaaaggggctcaggaatgggctcgggatcgggctcgggatcagggctgggagcagacccagatagagactcagaggcagacccagaaaggggctcaggaacgggcttgggaacagggtcgggaacaggccttgacaagtgggatggcgcctcgggcctgggagcagcccattagtggcatagctgagggagtggatgctgctggcaggagtggggggtccagaagcccagcccccagggatggtggacagtcagggggcagtggcctgggggagcccagcgccgggtacccacccccaggaagccgccccctcaggggcaagagcattgccacctctcccctggggctgggaaagagcccaactgagcccaagcctgaggctgggggctgcgggactccccaggccccggcccaggaggggtccccagaccaccctggggctgagagggccctgcaggacaggatggaggcatcggagcccgagcgtcgcgggaggtccaggcacctggccaagtacaaagcccagagcttccgtgaccagagggccttcgatttgtccttcagaccaatgagcgtcagggccagcgacacgtctgagctcccaaagtgaggccccgagtacacaccgtggctcgcccagcactgtgacatccgcccattgagggacttcaggcattttcctgcctccaaatgcgtcttggagcatccccta

SEQ ID NO: 461050 - DNA, 1315 bp, Homo sapiens
tgagccaaaatcatgccactgcactccagcctgagcaacagacaaagaccctgtctcaaacaacatcaacaaaccaggaactcaatcatttccaactgtgtgaagggccaagaggaaaatattcagggtgagggtccatgagagtgctggctaataggctaaacatggagacacacgacggaccttctagaaaagacattccctgataaaaagcaatggtgcccattgatgcttctgctctttgttctacccttgccttcctgcctcgaatgagaatatcaagaggcccctggcatgcaggaacttgcagtataaaatgcaaaacctccttgggaacaggagaacacaaaccacatgctgtgggtggcagaacagagagaggagcctgggtcccttctggcaccaagttgaggctggagccgcctgatctgtctccctctggaattttcctcatgacagaaaaataaattcctgtttggctaaaccactatcgtggagtatttgttacatgcggctaaaaactatcctaactgagcagggagacaactggaggctaggagaccaaggaaaagccaatgtccgacagcctctggcccaggttccggcaggtgccctcctgcatctggtgcgtcagctggtccttgtcctgcaagagcctcatggagtcatccgtcagccggctggcccacagccgggaggcctcggccccacgcacctgcagctggttggactggtcccagtcgtgggggctatagcgagagaagagtgcggagcgcagtgtgggcaggatggtgggcggccgcagggtactggtgctctcgtccgggcaggtctggacaaaacctttaaggaaggcatcacacccacatcttctagcgtgggatcagaaaagcaagtgggccctggtcctcccgacgttcacaacccttacctctcaggatcttctaagatgggacgtcacatacaggaggggactacacacagaaggcagccaagaaatggacgaaaaagtttcgagtatttttttaagcactaaatggttatggtaaaatattattttggaggaagtgtagggggaggcgaggggaaaaaaggttttttgtgtaacatcaacaagtataaagtgaaatttagggtttctcatcatccttggcttcttgtagcctcctcagatataactaatattatcagatttttccagagataattcatacatatatagcatatatctagatattgtcatatataacacactatgatattaataaaatatctaaaatatttataataatatcaagtgttaacacacagtgtt

SEQ ID NO: 461051 - DNA, 1169 bp, Homo sapiens
tgcataaaccagagtgggtcacatcactgccgttgtggggatgaggcagcctgaggaaatcccaggatgctggtgaaggtcccacagcagataaggagggtgtgcacccagctggaaggcttgatggataataccgagctgcctccattcctgataagctgtcacttgctacagggaagagagaaagagaaagcctgtgttcccagctatatacccaacaaaaatgaaaacgtatgtccaaccaaaaacttgtacacaaatgttcatagtgaaattataatggccataaagtggatatcccccaaaaaatatccatcattggaatggataatggggtatattcctacaattgaacattactgggccagaaaaaggaatgaagtactaatgcatgctacaacatggacaaaccttgaaaacattatgcagaaaagtgctcattaacccaagcctttctgcatagtgtccctaccaccctgctgcctctaactaaacaaaacacggtaggtctcagtgtgagagagcgcttttgttcacataggaggctgacagctatttgcgatgaggggtttttgtttgtttgtttgttattcaaataacttttttccccctgaggaaactgaaagggaaaatgtcagaagtatgtgattaatgattttttaaaatagatgggatctccccggttgaattgaaaagtaggtactgaaaaagaatccatttctaaatggtagattttcatatgtaagtttgatattaattctttcaaaagagttgtgcctgtgagtcagataaatgacaggaaggtctgtctaaataccagcatcctcggaagggcagctgttcagaaacattctcaaatcatgaagataaatagaaccggaacactgatgattccatcaactgatggttccttttaatcagatcttaaagcaaagacagaagctgaaaacatttctagtaaataaaaagcaaagaactctgaatgcttagccgaccagaaccccggaaggagcccgcctggtactgccaggcatgactgcctttagtggatttaacaataaaaaagaagatggcgccaaatgaccaaactacatgcgactttcccttcccgcaagaaaagtgaataaaactttccactggggctgggggaggaggcaagggaccagtcc

SEQ ID NO: 461052 - DNA, 583 bp, Homo sapiens
aagtaggctagtacgaaggctgcgtgtgaatcggccgaggcctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461053 - DNA, 2095 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctggtaggaacttttcattcgtctccacgccccgctccccgggctcgcgcggggcctcgtgcaccgagccggcctccaggcgggacggattcgggcctcccgcgctgtcttcctcgccttattccgggacggcgtgccaggcccccgcgggcttctccgtggccagcgcgtctgttagattgtcctctgcaagcgccgcgtcgcgcggcaccagcgctgatgtgtgtgtgtttttttcttctcccaacccaaagggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461054 - DNA, 1643 bp, Homo sapiens
  misc_feature (15)..(15): n is a, c, g, or t
  misc_feature (23)..(23): n is a, c, g, or t
gggcgcgaaaactantgcgcgangacggctcggcgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461055 - DNA, 1407 bp, Homo sapiens
gggcctggcactgaggcaaagatcctttgtgacaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461056 - DNA, 1189 bp, Homo sapiens
ggacgcgtgggtcgacccacgcgtcgccacgcgtccgggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461057 - DNA, 1165 bp, Homo sapiens
gggttgtgatcgtgcccctacactcttgctctgtctccctgggctggagtgcagtggcgcaatcgtggcttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461058 - DNA, 1975 bp, Homo sapiens
  misc_feature (28)..(28): n is a, c, g, or t
  misc_feature (120)..(120): n is a, c, g, or t
  misc_feature (1885)..(1885): n is a, c, g, or t
  misc_feature (1908)..(1909): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaacacacacacaacaacaaaaaaaaaaaacccggggggnctcttttgggggggggggaaaannggggttttgaaggggccggggccatatgttttccgggcccccttttttgtccagggggggaaaatg

SEQ ID NO: 461059 - DNA, 2673 bp, Homo sapiens
  misc_feature (28)..(28): n is a, c, g, or t
  misc_feature (120)..(120): n is a, c, g, or t
  misc_feature (1877)..(1877): n is a, c, g, or t
  misc_feature (1881)..(1881): n is a, c, g, or t
  misc_feature (1884)..(1884): n is a, c, g, or t
  misc_feature (1886)..(1886): n is a, c, g, or t
  misc_feature (1893)..(1893): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaaaaaaaaaaaaanaaanaananaaaaaanaaaaaagagggggggggggggggctaaaaaattatctcccccggagggggcccaaaattttgaggcgcgtgtccccccgtttttttgtgtaaaaggggggcccctatattaggggggggggtatttaaaagaggaagagagagggggggggcgggggtgtttaaaaaaggtgtgtggtaggggggaaaagggttagggggggatatcttggtgggagaggagaaccccctcttctggcgtgcgtgcggggatcaatcttgtgtggggcaccacattcacctacagagaagaattaaagggagcccgggggaaaaataacaacttcggagggggtatgggtggtgtttaaccacgggggctcatgatcttgcgggtgagaaaatgtggtcacggggattctttttttcttgaatactttttttccggcgctgttctcataacaacacaatgagatagatgacaaacaaatagaagaaggggaacgagggaagcgacatagaggagaggaaaaaaaaaaagcaagagagtagggggaagcagaggaaggagagacaaagacgaacagcaaaagcaagagagaaagcaaacatgcacagaaagcgaaacgagagcgagacgaacaaaagaaagaggcacgagacgagaagacacactagagagacaacaggcaagcgccagaaggcatgagcccggggcagagaacagaaaagatagtcggaaagagaggaccgcgacagcaccgacggagcaggggcaccgacgggaacaaaggcgcgagtt

SEQ ID NO: 461060 - DNA, 2235 bp, Homo sapiens
  misc_feature (28)..(28): n is a, c, g, or t
  misc_feature (120)..(120): n is a, c, g, or t
  misc_feature (1903)..(1903): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaaaaaatttttgggggggccttgggccctggaaaagtttncctaaaagaccaactcgcggtggggcgcgcgcgcggggcgcccagaggcgaataaggtgagacctgggcgcacagcggggttccctagaggaggaaacccggcgccaaagagacaaaggcggtcggggattctctcccccaaattaaaaaaaccgcgccgggagggggaaaccgcgagggggttcttctggacaccatattcccaaggaggggaggtcccgcgagggggccccataacgggggtatctctaccaccgcgggggggtccacacagggagagcccgatatattcaaattatagccccggctctagggggagtcaaaacaaatat

SEQ ID NO: 461061 - DNA, 1933 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtgtcgctttatccagccttattcttcattacccatgatgcagcggcctgggcatctaaaatagcgaccgctggcgtatcgcgctgatgcaaacagtgatagcaaggaacccgaatttgcggaattc

SEQ ID NO: 461062 - DNA, 1891 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaattttttttttttttttttttttttttttttttttttttttttttttt

SEQ ID NO: 461063 - DNA, 1742 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctggttggcaccttcaaggtcgcggtgttagaaggggtggggggtctccctggcctttggttgcctttctgtgtccgccctcgtggggaacgcgggtggggtggacctcgccagtattg

SEQ ID NO: 461064 - DNA, 1661 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtcggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461065 - DNA, 1992 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtcggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaaaaaacttgtgtgtggggcggcctgtgggccttggaaaaagttttttgaacccttgtggtgtgtggggcgggggggccccagtggtggttacgtgtgaccggggccaaaaggggtgcgcccctagggagactccggggcacgtgggacaaaggggcgcgtgggactctcctcccacaattaaaaaaaccgcgcggggggacaaccggggggtgtttcgggaaacaacctccagaggggaggtccgaggggcccatacgggggactcacaccgacaggggggtccccaaggaaggctgaaatataaaataca

SEQ ID NO: 461066 - DNA, 1224 bp, Homo sapiens
gggcctggcactgaggcaaagatcctttgtgacaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtcggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461067 - DNA, 1370 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgcccggtcctattccactcatcggagtgccagatggcatgtcgcatagacgatggccggggagaaggaaggcgtccgacgaaaaagagtaaatgctaaactaacgagggtgtggcggtgaaccgtcacctgcggagtttgggaaaggagtgcccggagggaggatgggcaggcccacacatggagcgggggggaagaggacaaataagggagggggtgcatatagtgttg

SEQ ID NO: 461068 - DNA, 1028 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccggcgcagtctgtgataaggatcctgctagagtga

SEQ ID NO: 461069 - DNA, 1651 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctggtaggaacttttcattcgtctccacgccccgctccccgggctcgcgcggggcctcgtgcaccgagccggcctccaggcgggacggattcgggcctcccgcgctgtcttcctcgccttattccgggacggcgtgccaggcccccgcgggcttctccgtggccagcgcgtctgttagattgtcctctgcaagcgccgcgtcgcgcggcaccagcgctgatgtgtgtgtgtttttttcttctcccaacccaaagggtgacttttaaatatgacggctccaccatcgtccccggcgagcagggagcggagtaccagcacttcatccagcagtgcacaggctggagtgcagtggtacaatctcagctaactgcaacctccgtctcccgggttcaagagattctcctgcctcagcctcctgagtagctgggattacaggcgcccacgaccacgcctggctaattttttgtaattttagtagagatgggggtttcaccattttggccaggctggtctctaacttctgaccttaggtgatctgcccaccttggcctctcaaagtgctgggattacaggcgtgagccactgcgcccggccgacggtgtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccagggatcatggacaatggactcaacactggcactggctggatagcagtcaccacgctcgacgtgccttatcttggtcatacctcagaacagcctggtgtggcagctcttcccctgtgccgcgctggcctgccttcccgcttccctaggcctgtggactctcttccctctgcctgcactgtcttcatctgtttcgccttcctggaggactcctacacacccgtcaaggcccggtgtgaatgttccctctgctcggatgccctccttgtctttgtggtgttggtgtcccgtgtggtggtcgtgtgcatgtctgtttcttcaactccttggcgaagtcctcctggagagagggactttgtccctttggtggtgtattggcagcgctgggaacagtacctggcagcctgcacagatgttgttgagtaggcaaatgagtgacagtccatgtagatgtctgagagctaagctcacacaggagggcccgccgtcccctcctccaaagtaacagcccagtggcccacaaggctcccggccgctaccactggccatgtgactgctctggccccaggcctcttactccagagcccaggcatcgccaccttcctctc

SEQ ID NO: 461070 - DNA, 1108 bp, Homo sapiens
  misc_feature (8)..(8): n is a, c, g, or t
  misc_feature (12)..(12): n is a, c, g, or t
  misc_feature (16)..(16): n is a, c, g, or t
  misc_feature (20)..(20): n is a, c, g, or t
  misc_feature (24)..(24): n is a, c, g, or t
  misc_feature (26)..(26): n is a, c, g, or t
  misc_feature (28)..(28): n is a, c, g, or t
tttatttnaganagantctncctntntngcccaggctggagtgcagtggtacaatctcagctaactgcaacctccgtctcccgggttcaagagattctcctgcctcagcctcctgagtagctgggattacaggcgcccacgaccacgcctggctaattttttgtaattttagtagagatgggggtttcaccattttggccaggctggtctctaacttctgaccttaggtgatctgcccaccttggcctctcaaagtgctgggattacaggcgtgagccactgcgcccggccgacggtgtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccagggatcatggacaatggactcaacactggcactggctggatagcagtcaccacgctcgacgtgccttatcttggtcatacctcagaacagcctggtgtggcagctcttcccctgtgccgcgctggcctgccttcccgcttccctaggcctgtggactctcttccctctgcctgcactgtcttcatctgtttcgccttcctggaggactcctacacacccgtcaaggcccggtgtgaatgttccctctgctcggatgccctccttgtctttgtggtgttggtgtcccgtgtggtggtcgtgtgcatgtctgtttcttcaactccttggcgaagtcctcctggagagagggactttgtccctttggtggtgtattggcagcgctgggaacagtacctggcagcctgcacagatgttgttgagtaggcaaatgagtgacagtccatgtagatgtctgagagctaagctcacacaggagggcccgccgtcccctcctccaaagtaacagcccagtggcccacaaggctcccggccgctaccactggccatgtgactgctctggccccaggcctcttactccagagcccaggcatcgccaccttcctctc

SEQ ID NO: 461071 - DNA, 1844 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461072 - DNA, 1394 bp, Homo sapiens
ttcgtacttggcgtcccctcgccttctcgctcgctcttgatgacatcttcctccagctccttccgatcactgatcacggagactccttagcgaaattctgtacgaccgcctccaccagggtcttgtccgtcccggttttggcgcgctgcagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461073 - DNA, 1988 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaacttgcggaggcatttatgggcggggggcgggaaaaagcggggtattggaattgggccattgggccaataacggttgttctcttggacccagtttttttggtccaaggggggaaatttgcgcgg

SEQ ID NO: 461074 - DNA, 2430 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaatcggggttttttttgttttttttgttaatggtggggaagccctttttgagaagaaccgtggggaattttggtaaaaaaaaaaaggggggaaaacaaactcgtcgtgtggggagaaaacaaggcccccagaaagtactcgacaaggaggagccacaccccaaggcacgaacagtgggagaaacgcccacatggaaggaggcgtagaaactacacaacacaccacacttaataaggggaagaaaggagaacgaatagagacgtagagacgaacggcccatttaagtacaaaaaggtccaaacgcgaataccacataagtggacggagaacacctgggaaaagggggcacactgccaaaagaaggagccgccaaaagaatacacacagagccctggtaccaacccgggtaaaccagggggcgccaaaacccgggcgcgagaagcagaacccctggagaaaaagcgatagcaaaaggaaccctgcacaaggcttggcacaggcaaagtgccagcggagacgggagcccccgggaagtccccaaagagtgaggcagatcggaacgaacgg

SEQ ID NO: 461075 - DNA, 2652 bp, Homo sapiens
  misc_feature (28)..(28): n is a, c, g, or t
  misc_feature (120)..(120): n is a, c, g, or t
  misc_feature (1856)..(1856): n is a, c, g, or t
  misc_feature (1860)..(1860): n is a, c, g, or t
  misc_feature (1863)..(1863): n is a, c, g, or t
  misc_feature (1865)..(1865): n is a, c, g, or t
  misc_feature (1872)..(1872): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaanaaanaananaaaaaanaaaaaagagggggggggggggggctaaaaaattatctcccccggagggggcccaaaattttgaggcgcgtgtccccccgtttttttgtgtaaaaggggggcccctatattaggggggggggtatttaaaagaggaagagagagggggggggcgggggtgtttaaaaaaggtgtgtggtaggggggaaaagggttagggggggatatcttggtgggagaggagaaccccctcttctggcgtgcgtgcggggatcaatcttgtgtggggcaccacattcacctacagagaagaattaaagggagcccgggggaaaaataacaacttcggagggggtatgggtggtgtttaaccacgggggctcatgatcttgcgggtgagaaaatgtggtcacggggattctttttttcttgaatactttttttccggcgctgttctcataacaacacaatgagatagatgacaaacaaatagaagaaggggaacgagggaagcgacatagaggagaggaaaaaaaaaaagcaagagagtagggggaagcagaggaaggagagacaaagacgaacagcaaaagcaagagagaaagcaaacatgcacagaaagcgaaacgagagcgagacgaacaaaagaaagaggcacgagacgagaagacacactagagagacaacaggcaagcgccagaaggcatgagcccggggcagagaacagaaaagatagtcggaaagagaggaccgcgacagcaccgacggagcaggggcaccgacgggaacaaaggcgcgagtt

SEQ ID NO: 461076 - DNA, 1836 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattctgagcacatttgatatagctctttttctgtttttccttgctcatttcgttttggggaagaaatctgtactgtattgggattgtaaagaacatctctgcactcagacagtttacagaaataaatgttttttttgtttttcagaaaattttttttttttttttttttttttttttttttttttttttttttttt

SEQ ID NO: 461077 - DNA, 1689 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtcgactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaa

SEQ ID NO: 461078 - DNA, 1337 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtcacgacgattccggtcaggatcctgctagagtcac

SEQ ID NO: 461079 - DNA, 1166 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccaggatatgcgtcccgaatatgcgtgtatactcaggaatcgactatgcacccaatacgat

SEQ ID NO: 461080 - DNA, 1130 bp, Homo sapiens
  misc_feature (28)..(28): n is a, c, g, or t
  misc_feature (120)..(120): n is a, c, g, or t
agcggggaatccgccgccgcgctcgcanctcgcaggcgccgcgtagccgtcgccaccgccgccagcccgtgcgccctcggcgcgtacccgccgcgctcccatccccgccgccggccaggngcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgtgatctgcctgcctcagcctcccaaagtgctgggattacaggcgtgagccaccgcatcccacctagtatatgcattttaaagatagaccaacccacccttgaaagcagcaagtaccccagccccggtcacactgcagagaagagctgaaccc

SEQ ID NO: 461081 - DNA, 1109 bp, Homo sapiens
aagaagaaaaatatggctgtttttgcccaaccctgcaggcagtcagaccttatggttgtcttcccttgttccctaaaattgctgttattctgttctttttcaaggtgcactgatttcatattgttcaaacacacatgttttacaatcaatttgtacagttaatacaattgtcatagtggtcctgaggtgacgtacatccttcagcttatgaagataacacgattaagagattaaactccagccggtccctctgttcggggtccctgacttcctgcaacaggtcctccaatatgctgcccaaaacaggctctttctggctgtcaggagggcggaggtatctggagggggtgcagcctccatagggtacaggtcccaaagcctccaagactagcagctgtgccctggggtctccatgcctccatcctgcccaaacacttattcatattgataagatttcaaatttatataataactttcaaataaagaatttgactttttaatgaaaatttccatgtcttctttacccctctatattatttcctccccacggcacacagctgcttgtgctcaagtcctgccagttgacagaaagctcccttgtcttgtgactactgcattaggcagaaggagcaaagaaagggcacaacggaccacgggcaagaaagcagaaaagggggttcctgatgtaaaaagtaaagaactatcatctgaagaaggccacacctactggaaaaatatatgtcagccccagaaaattgtgggcaagatgaggcaagtcctgagcaacacaggaaactgccctcctccttttctggccccgcttccactcttcatcatggcctatgaacagccaaagggtaaaatgatcagaaaactggacagtttttgacagtcttgttaagacttaaagggtaaatggctctttgataaagagagatcataaaaaagtaagatccacacagcttaacctcccagggggcaattaagatgctttaatgtgaagtgaatgacgacgtggtagagtttgatgtgaatgtaatagcataggaaggccggagggcatgggggcctctcaacctcattctctgtactagatgcggcatctggag

SEQ ID NO: 461082 - DNA, 3047 bp, Homo sapiens
gtcatcacctaagccagctgtcgggcactgactctctgggctacattctcccgtgggttctctttaacccgcttggtttcaccgcaggggaatgctgaagagacacaagtgtttttgttttctctcttaaaaaatacagaaactgtaatctgttttacatctgggtctgactgcagacaagcaagagcgggcggaatggagtgatgggcaatccagctgcaagaagaggtgcatacccctctgtagacagcacatctgtgcaggtgtctaacagccgcctcatggaaggagtcatggaagacgttaggcccctccagttgggatcaagcaactgatgcaagctttggaccaaatgaaacatttcaagaactcagattgtaaaatcacaatcagctggaggaattcggatctgcatctggcccagaagaacatttttgaggatcttttgaaagtatcactaagagcaaggctggtgaattgaattactgccattattccccaaggaaagaaggattcatttcattcctaactgcaaggcattcagcaggttaactggcaagtggaaaagagcctaaccaaattatcccttgggaccatcaaaacatttaataaaccaagacacaaatgcctcccaaaaattccatctgcaagaaacattttctgcatcaagaagcacaaaggagataagtgttctattcatccacgcaggcaacgctgtcacccaggaagtgttgctcagggggccttactccacagctggcctccgatgtgtaggcaggcctggaacagaatcaattgcaaaaaaaaaaaaaaaaaaacagaaaaaaaaaagaaaaaaaacagcatcgtctgtgggattctccctcaatgtctgttccgtgaaagatgcattttgtcctctggagcctggtgttggaaataaacttggctgcacagcttcatccatgtccctgcaaaggacatgaactcatccttttttatggatgcatagtattccttggtgtatatataccacattttcttaatccagtctatcattgatggacatttgggttggttccaagtctttgctattgtgaatagtgacacaataaacatacgtgtgcatgtgtctttatcatagaatgatttataatcctttgggtatacacccagtaatggtattgctgagtcaaatggtatttctagttctagatctttgaggaattgccacactgtcttccacaatggttgaactaatttacactccaacagtgtaaaagtgttcctatttttccacaacctctgcagcatctgttgtttcctgacaaaatttttaatgatcgccattctaactggcataagatggtatctcattgtggctttgatttgcatttctctaatgaacagtcatgatgatgagccttttttcgtatttctgttggctgcataaatgtcttcttttgagaaatgtctgttcatatcctttgcccattttttgatggggtttttgtttttttcttgtaaatttgtttaagttctttgtagattctggatattagccctttgtcagatggatagattgcaaaaattttctgccattctgtaggtttcctgttccctctaatgataatttcttttgctgtgcagaagctctttagtttaattggatcccatttgtcaactttggcttttgttgccattgcttttggtgttttagacatgaagtctttgcccatgtctatgtcctgaatggagggattgcctaggttttcttctaggatttttacggtcctaggtcttacattttaagtctttgatccatcttgagttgacttttgtataaggtataaggaaagggtccagtttcagtcttctgcatatccctagccagttttcccaacaccatttattaaatagggaatcttttcctcattgcttgtgtgtgtcaggtttgtcaaagatcagatggttgtagacgtgtggtgttatttctgaggcctcccttctgttccattggtctatatatctgttttggtaccagtaccatgctgttttgattactgtagccttgtagtacagactgaagtcaggtagcgtgatgcctccagctttggtcttgtccaggattgtcttggcaatgcaggctcttttttggttccatatgaactttaaagtagttttttccaattccgtgaagaaagtcagtggtagtttgacggggatagtattgaatctataaattacttcgggcagtatggccattttcacaatattgatttttcctattcatgagcatggaacgtttttccatttgtttgtgtcctctcttatttccttgagcagtggtttgtagttctctctgaagaggtccttcacatcccttgtaagtcggattcctaggtattttattctctttgaagcaattgtgaatgggagttcactaatgatttggctccctgtttgtctgttattggtgtataggaatgcttgtgatgtttgcacattgattttttatcctgagactttgctgaagttgcttatcagcttaaggagattttggggtgagacgatggggttttctaaatatacaatcatgtcatctgcaaacagaggctatttgatttcctctctttctattcagataccctttattgctttctcttgcctgattgccctggccagaacttccaatactatgttgaataggagtgacttctcctcctggctcagtgtggatctaccaggaaacttcaggttaaatctacagtgggcaaatgtgttttccaaacctgttcttattaatctatgggtaggatccctgaatggagtgcagggagaaggaaaagagaaggaggcggcgcccttcacaggaggaccttttggttgctgctggaacatgagaaatgttgcctctcaagaatttcaacagtaattcaatgctacggctgaagaaaacaaggaacaagcttctcccttcctctgccgttcctcccctcttggcgtgtaagcctgtgttcagagctcttgcttttgaagcataagtgattacaacttggcaatggtgt

SEQ ID NO: 461083 - DNA, 1997 bp, Homo sapiens
tctgagagaggaagatggctacaggacgtagcaagttgaaatggaccaacgagcaatggcctgagcaaataactttgatcgagccatcactggtgacaggacttgaacacatttctggaagcatgagtatgccatccaggaggagagagaagtcatccacacaaatgcctgcgattccgaataatgcgttctatgtcaataggaaggtaccaacaaactgtgatgtgagagatcaagggggcttcacaagagaagagctgcggaagctgcttggaggaggagaaagagcattcatccctttgcagacaaacaccagaggtcctcagtgtcacatgccagccaagctcagagcatctcaacaatgccagggagtcttggcatggggctgggccatgggcttggttctgactcagagaagtcggaaccacctactgagtcatttgcaggagctgtggtttcctgggaggtttcccaaccagttacccaccccgccaaatcgctgaatgatgggctagagctctaccatctaaaatggtagccgctagccacatggctatataaatttcaataaattaaaattaaatactattaagaaattccattcctctctcacactagccacatttcaagggcccaacagccacaagagactagtggctgcagtattaagtaacacaaatagagagcatttccatcattgcagaaagttcagaggcatgcaccagagactctaagcagcacgtgttgatccaaaatgtgctccataaaccatatgcgtctgaaggcaagaacagaggcgagcttgtcaaagtgcacattcctgggctcctccctagacttcccaggtccgtatctctgggggctggaggggaggcctgggaatcagtattttggcaagcactcccagatggctattatgcaaactcacacttcaggatgagcactccaagggaagccagaagttgaagagcgaagcgggaaaacctcctgatatggcgattctgggcatatcagatgtcttgtagcactttctactccactgtaagatttcccaaccaaacattttcaagagaatgcgactggagcctccagactgacagctaagtgcgcatctcagtaaagtcctggctgttcttccatcaagtaaaccaggaggatggaaataacctcgttgctccccttgagtgtgtttgaatcacaagtaccttccctctaacataaatttatttcccgctgccttcctctcaacaaagaccagccagtgatgaataccagacttcatagcttatttgtcaaagcagcacacctgtgaggattccctgtgaaagataaattttgatagggggagggagggctggaggaggagggacctggccaggaataaatcttaacatgttgcaccagactgtgaatgagcgcttgcctcacaaagcttgccgtcttgacaaggtatgataaattaccctctttgttgacaccttcattgggttatttatggctcattaattgaaccaaaaaggggccttgtagacccagcaggggcaccatacaatgctcctccaatggacccagctcaaagaaaagaacaaaggagggaagagtgggagcggggcacacaagtgtgtctgctccttggcttgagacactcttcaccaaacaattcaagattaaaaaaagaagaagaagaaagaaagaaaagaaaaaaaccctttggaagctcagggaaaagatatgggcagggcagttcagtgttccagagagattctctagtgccagggaatgtgacctggagaagatgggaggatgggaggaaaatcttgcttgatgactgttgcagtagtccaaacaagagaaagcacgggccccaaacaagggcatggctgtgaggaagaaatgaagctgcagaggcaaagtatatgcacattttaaagtttgcagcatattatagccaaataccctctctgagaagatgtaccactgtgcttaaaatgtcattc

SEQ ID NO: 461084 - DNA, 1943 bp, Homo sapiens
tctgagagaggaagatggctacaggacgtagcaagttgaaatggaccaacgagcaatggcctgagcaaataactttgatcgagccatcactggtgacaggacttgaacacatttctggaagcatgagtatgccatccaggaggagagagaagtcatccacacaaatgcctgcgattccgaataatgcgttctatgtcaataggaaggtaccaacaaactgtgatgtgagagatcaagggggcttcacaagagaagagctgcggaagctgcttggaggaggagaaagagcattcatccctttgcagacaaacaccagaggtcctcagtgtcacatgccagccaagctcagagcatctcaacaatgccagggagtcttggcatggggctgggccatgggcttggttctgactcagagaagtcggaaccacctactgagtcatttgcaggagctgtggtttcctgggaggtttcccaaccagttacccaccccgccaaatcgctgaatgatgggctagagctctaccatctaaaatggtagccgctagccacatggctatataaatttcaataaattaaaattaaatactattaagaaattccattcctctctcacactagccacatttcaagggcccaacagccacaagagactagtggctgcagtattaagtaacacaaatagagagcatttccatcattgcagaaagttcagaggcatgcaccagagactctaagcagcacgtgttgatccaaaatgtgctccataaaccatatgcgtctgaaggcaagaacagaggcgagcttgtcaaagtgcacattcctgggctcctccctagacttcccaggtccgtatctctgggggctggaggggaggcctgggaatcagtattttggcaagcactcccagatggctattatgcaaactcacacttcaggatgagcactccaagggaagccagaagttgaagagcgaagcgggaatccactgtaagatttcccaaccaaacattttcaagagaatgcgactggagcctccagactgacagctaagtgcgcatctcagtaaagtcctggctgttcttccatcaagtaaaccaggaggatggaaataacctcgttgctccccttgagtgtgtttgaatcacaagtaccttccctctaacataaatttatttcccgctgccttcctctcaacaaagaccagccagtgatgaataccagacttcatagcttatttgtcaaagcagcacacctgtgaggattccctgtgaaagataaattttgatagggggagggagggctggaggaggagggacctggccaggaataaatcttaacatgttgcaccagactgtgaatgagcgcttgcctcacaaagcttgccgtcttgacaaggtatgataaattaccctctttgttgacaccttcattgggttatttatggctcattaattgaaccaaaaaggggccttgtagacccagcaggggcaccatacaatgctcctccaatggacccagctcaaagaaaagaacaaaggagggaagagtgggagcggggcacacaagtgtgtctgctccttggcttgagacactcttcaccaaacaattcaagattaaaaaaagaagaagaagaaagaaagaaaagaaaaaaaccctttggaagctcagggaaaagatatgggcagggcagttcagtgttccagagagattctctagtgccagggaatgtgacctggagaagatgggaggatgggaggaaaatcttgcttgatgactgttgcagtagtccaaacaagagaaagcacgggccccaaacaagggcatggctgtgaggaagaaatgaagctgcagaggcaaagtatatgcacattttaaagtttgcagcatattatagccaaataccctctctgagaagatgtaccactgtgcttaaaatgtcattc

SEQ ID NO: 461085 - DNA, 2052 bp, Homo sapiens
tctgagagaggaagatggctacaggacgtagcaagttgaaatggaccaacgagcaatggcctgagcaaataactttgatcgagccatcactggtgacaggacttgaacacatttctggaagcatgagtatgccatccaggaggagagagaagtcatccacacaaatgcctgcgattccgaataatgcgttctatgtcaataggaaggtaccaacaaactgtgatgtgagagatcaagggggcttcacaagagaagagctgcggaagctgcttggaggaggagaaagagcattcatccctttgcagacaaacaccagaggtcctcagtgtcacatgccagccaagctcagagcatctcaacaatgccagggagtcttggcatggggctgggccatgggcttggttctgactcagagaagtcggaaccacctactgagtcatttgcaggagctgtggtttcctgggaggtttcccaaccagttacccaccccgccaaatcgctgaatgatgggctagagctctaccatctaaaatggtagccgctagccacatggctatataaatttcaataaattaaaattaaatactattaagaaattccattcctctctcacactagccacatttcaagggcccaacagccacaagagactagtggctgcagtattaagtaacacaaatagagagcatttccatcattgcagaaagttcagaggcatgcaccagagactctaagcagcacgtgttgatccaaaatgtgctccataaaccatatgcgtctgaaggcaagaacagaggcgagcttgtcaaagtgcacattcctgggctcctccctagacttcccaggtccgtatctctgggggctggaggggaggcctgggaatcagtattttggcaagcactcccagatggctattatgcaaactcacacttcaggatgagcactccaagggaagccagaagttgaagagcgaagcgggaaaacctcctgatatggcgattctgggcatatcagatgtcttgtagcactttctactccactgtaagatttcccaaccaaacattttcaagagaatgcgactggagcctccagactgacagctaagtgcgcatctcagtaaagtcctggctgttcttccatcaagtagtaaaaactgaagaaagtggctgtcctagcattatctccttcttgccttttgcagaaccaggaggatggaaataacctcgttgctccccttgagtgtgtttgaatcacaagtaccttccctctaacataaatttatttcccgctgccttcctctcaacaaagaccagccagtgatgaataccagacttcatagcttatttgtcaaagcagcacacctgtgaggattccctgtgaaagataaattttgatagggggagggagggctggaggaggagggacctggccaggaataaatcttaacatgttgcaccagactgtgaatgagcgcttgcctcacaaagcttgccgtcttgacaaggtatgataaattaccctctttgttgacaccttcattgggttatttatggctcattaattgaaccaaaaaggggccttgtagacccagcaggggcaccatacaatgctcctccaatggacccagctcaaagaaaagaacaaaggagggaagagtgggagcggggcacacaagtgtgtctgctccttggcttgagacactcttcaccaaacaattcaagattaaaaaaagaagaagaagaaagaaagaaaagaaaaaaaccctttggaagctcagggaaaagatatgggcagggcagttcagtgttccagagagattctctagtgccagggaatgtgacctggagaagatgggaggatgggaggaaaatcttgcttgatgactgttgcagtagtccaaacaagagaaagcacgggccccaaacaagggcatggctgtgaggaagaaatgaagctgcagaggcaaagtatatgcacattttaaagtttgcagcatattatagccaaataccctctctgagaagatgtaccactgtgcttaaaatgtcattc

SEQ ID NO: 461086 - DNA, 1363 bp, Homo sapiens
tctgagagaggaagatggctacaggacgtagcaagttgaaatggaccaacgagcaatggcctgagcaaataactttgatcgagccatcactggtgacaggacttgaacacatttctggaagcatgagtatgccatccaggaggagagagaagtcatccacacaaatgcctgcgattccgaataatgcgttctatgtcaataggaaggtaccaacaaactgtgatgtgagagatcaagggggcttcacaagagaagagctgcggaagctgcttggaggaggagaaagagcattcatccctttgcagacaaacaccagaggtcctcagtgtcacatgccagccaagctcagagcatctcaacaatgccagggagtcttggcatggggctgggccatgggcttggttctgactcagagaagtcggaaccacctactgagtcatttgcaggagctgtggtttcctgggaggtttcccaaccagttacccaccccgccaaatcgctgaatgatgggctagagctctaccatctaaaatggtagccgctagccacatggctatataaatttcaataaattaaaattaaatactattaagaaattccattcctctctcacactagccacatttcaagggcccaacagccacaagagactagtggctgcagtattaagtaacacaaatagagagcatttccatcattgcagaaagttcagaggcatgcaccagagactctaagcagcacgtgttgatccaaaatgtgctccataaaccatatgcgtctgaaggcaagaacagaggcgagcttgtcaaagtgcacattcctgggctcctccctagacttcccaggtccgtatctctgggggctggaggggaggcctgggaatcagtattttggcaagcactcccagatggctattatgcaaactcacacttcaggatgagcactccaagggaagccagaagttgaagagcgaagcgggaaaacctcctgatatggcgattctgggcatatcagatgtcttgtagcactttctactccactgtaagatttcccaaccaaacattttcaagagaatgcgactggagcctccagactgacagctaagtgcgcatctcagtaaagtcctggctgttcttccatcaagtagtaaaaactgaagaaagtggctgtcctagcattatctccttcttgccttttgcagaaccaggaggatggaaataacctcgttgctccccttgagtgtgtttgaatcacaagtaccttccctctaacataaatttatttcccgctgccttcctctcaccaccttgtagcatccctgggcaagatcaaatttcattgggcaagctagggcttctcccct

SEQ ID NO: 461087 - DNA, 3470 bp, Homo sapiens
ggctggctgtcctacagcctgtgttttggggtcaaagacacgtcattcacatgcggaggaaacaccttctttggcctagacatctgctggtgacaactcaggatgaccaaggatacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgccc

SEQ ID NO: 461088 - DNA, 410 bp, Homo sapiens
  misc_feature (387)..(387): n is a, c, g, or t
gtgctgcaagaaaagtcacagccttggggtttcagtgaagagacagcccaaatgctcttgaagtagtcagaaaagtctacaggtgtgactcccttatgccgctctctcctgccatttgggcaacagccaacttccgaggccaaccttgtttctggagaagcattcttcccacatgggaaaggcaaggatggtgctgagcctgtctgcctctgtgttccctggacaactccattccagtgcaagattctcatggttgaattcatcagaaatgtaaaattaacaaggaattgttcacctgatgaaaaggaacatggagagatggttcttgaatctgaataggaggagatcgtgcctggacacactaggaggagggggctacatgatttnggggggaagcagggatttatata

SEQ ID NO: 461089 - DNA, 413 bp, Homo sapiens
gtgctgcaagaaaagtcacagccttggggtttcagtgaagagacagcccaaatgctcttgaagtagtcagaaaagtctacaggtgtgactcccttatgccgctctctcctgccatttgggcaacagccaacttccgaggccaaccttgtttctggagaagcattcttcccacatgggaaaggcaaggatggtgctgagcctgtctgcctctgtgttccctggacaactccattccagtgcaagattctcatggttgaattcatcagaaatgtaaaattaacaaggaattgttcacctgatgaaaaggaacatggagagatggttcttgaatctgaataggaggagatcgtgcctggacacactaggaagaatcttctgcattgatttgattaaaaaacaactatgtaaatacc

SEQ ID NO: 461090 - DNA, 1409 bp, Homo sapiens
gtgctgcaagaaaagtcacagccttggggtttcagtgaagagacagcccaaatgctcttgaagtagtcagaaaagtctacaggtgtgactcccttatgccgctctctcctgccatttgggcaacagccaacttccgaggccaaccttgtttctggagaagcattcttcccacatgggaaaggcaaggatggtgctgagcctgtctgcctctgtgttccctggacaactccattccagtgcaagattctcatggttgaattcatattttaagtgctgtttgtggggttttgagcagttgccattctgaggaggagcagaggagcatggctttgccaaagtgtctcccaattatgagcaccatctgcaagagtccacttggaaaatactcaagagtgggcttctatgacttctgccttgccctggaggtccaatacaggaccagcaagttatttctgtgtggacagcccagtcccagaaggagcttgggaatacagcagcaggctttaaagcttgcctgtctttcgcctacgcttctggaatcctcaagttgtgttgacccacctgggaacactgctggttccagaatgccaagctccagtaattgtataaaataaaattaaaataccagaaggatgtatttgcaaacaaactatagagctttaagattatacagcagttaagaaagtatgagtgaattttatattatgtatattgtaccatggaaaagaatgagaaggagcaggaggaggaggaaaagaaggagaagaacagcaagaagaaagaagaagaggaggaggaagaaggaggaggagaagaagaagaagaagaaggagaaggaggagaagaagaagaagaagaagaagaagaagaagaagaagaagaagaagaagaagaagaagaagaagaagaaaagaagaagaagaagaagaagaagaagaagaagaagaagaagaagaagaagaagaagaagaagaggaagaagaagaagaaagaagaagaagaaaaagtagtggaggaggaggatgaattcatttggtttttgggaaactctctctatttcccttctttttctcattttgcctcagatctgattttctggctgtggtcacagcaggccagcatgtggacaaagggaaacgcctggtgtgaaggtgttagttttgacagtgaattccaagtagagaagatgaaggggaaaggagacttcgtgtgaactcgatgatcatggatttcacttcaaatacaaaccatgtccagctaattgtggccaggtgaggggactggccgcaggtgaccaggtctaaaaccctttcaaacgaagttggaaatgtgtttttttatataaaaggccgtgtttgaaaatattaccaactacttcaatgtttctttttaaaattatctggggggcc

SEQ ID NO: 461091 - DNA, 1054 bp, Homo sapiens
gtgctgcaagaaaagtcacagccttggggtttcagtgaagagacagcccaaatgctcttgaagtagtcagaaaagtctacaggtgtgactcccttatgccgctctctcctgccatttgggcaacagccaacttccgaggccaaccttgtttctggagaagcattcttcccacatgggaaaggcaaggatggtgctgagcctgtctgcctctgtgttccctggacaactccattccagtgcaagattctcatggttgaattcatattttaagtgctgtttgtggggttttgagcagttgccattctgaggaggagcagaggagcatggctttgccaaagtgtctcccaattatgagcaccatctgcaagagtccacttggaaaatactcaagagtgggcttctatgacttctgccttgccctggaggtccaatacaggaccagcaagttatttctgtgtggacagcccagtcccagaaggtaaaaccattcttaactatagtaaggaccatcacactcagctgacctaagagcctaacaacctgctctttgggggcagtaggacaatggggtaggaactccatcctcgctgccgcgccttcatggtacggtagatgcgctttttctctcccttgctagacagggccgccttgggaccctgtgggctattggatggcgattgctccaacttttttgcattcaacatgagcagcttcctggcaagagtactgggaaactatagcctgaactttcctcttaacagggaccctttattttttccgcacaggagcttgggaatacagcagcaggctttaaagcttgcctgtctttcgcctacgcttctggaatcctcaagttgtgttgacccacctgggaacactgctggttccagaatgccaagctccacagaaatgtaaaattaacaaggaattgttcacctgatgaaaaggaacatggagagatggttcttgaatctgaataggaggagatcgtgcctggacacactaggaagaatcttctgcattgatttgattaaaaaacaactatgtaaatacc

SEQ ID NO: 461092 - DNA, 1716 bp, Homo sapiens
gtgctgcaagaaaagtcacagccttggggtttcagtgaagagacagcccaaatgctcttgaagtagtcagaaaagtctacaggtgtgactcccttatgccgctctctcctgccatttgggcaacagccaacttccgaggccaaccttgtttctggagaagcattcttcccacatgggaaaggcaaggatggtgctgagcctgtctgcctctgtgttccctggacaactccattccagtgcaagattctcatggttgaattcatattttaagtgctgtttgtggggttttgagcagttgccattctgaggaggagcagaggagcatggctttgccaaagtgtctcccaattatgagcaccatctgcaagagtccacttggaaaatactcaagagtgggcttctatgacttctgccttgccctggaggtccaatacaggaccagcaagttatttctgtgtggacagcccagtcccagaaggtaaaaccattcttaactatagtaaggaccatcacactcagctgacctaagagcctaacaacctgctctttgggggcagtaggacaatggggtaggaactccatcctcgctgccgcgccttcatggtacggtagatgcgctttttctctcccttgctagacagggccgccttgggaccctgtgggctattggatggcgattgctccaacttttttgcattcaacatgagcagcttcctggcaagagtactgggaaactatagcctgaactttcctcttaacagggaccctttattttttccgcacaggagcttgggaatacagcagcaggctttaaagcttgcctgtctttcgcctacgcttctggaatcctcaagttgtgttgacccacctgggaacactgctggttccagaatgccaagctccagtaattgtataaaataaaattaaaataccagaaggatgtatttgcaaacaaactatagagctttaagattatacagcagttaagaaagtatgagtgaattttatattatgtatattgtaccatggaaaagaatgagaaggagcaggaggaggaggaaaagaaggagaagaacagcaagaagaaagaagaagaggaggaggaagaaggaggaggagaagaagaagaagaagaaggagaaggaggagaagaagaagaagaagaagaagaagaagaagaagaagaagaagaagaagaagaagaagaagaagaagaaaagaagaagaagaagaagaagaagaagaagaagaagaagaagaagaagaagaagaagaagaagaggaagaagaagaagaaagaagaagaagaaaaagtagtggaggaggaggatgaattcatttggtttttgggaaactctctctatttcccttctttttctcattttgcctcagatctgattttctggctgtggtcacagcaggccagcatgtggacaaagggaaacgcctggtgtgaaggtgttagttttgacagtgaattccaagtagagaagatgaaggggaaaggagacttcgtgtgaactcgatgatcatggatttcacttcaaatacaaaccatgtccagctaattgtggccaggtgaggggactggccgcaggtgaccaggtctaaaaccctttcaaacgaagttggaaatgtgtttttttatataaaaggccgtgtttgaaaatattaccaactacttcaatgtttctttttaaaattatctggggggcc

SEQ ID NO: 461093 - DNA, 1194 bp, Homo sapiens
cttatccccaatttacaaatgaagaaatggaagtcaagacttttcccaaggccaccaaactggttaagtggcaagtacttaaggctcccaagttcagcaatgtttctaatagacttctgcctctgtgttccctggacaactccattccagtgcaagattctcatggttgaattcatagtgggcttctatgacttctgccttgccctggaggtccaatacaggaccagcaagttatttctgtgtggacagcccagtcccagaaggagcttgggaatacagcagcaggctttaaagcttgcctgtctttcgcctacgcttctggaatcctcaagttgtgttgacccacctgggaacactgctggttccagaatgccaagctccagtaattgtataaaataaaattaaaataccagaaggatgtatttgcaaacaaactatagagctttaagattatacagcagttaagaaagtatgagtgaattttatattatgtatattgtaccatggaaaagaatgagaaggagcaggaggaggaggaaaagaaggagaagaacagcaagaagaaagaagaagaggaggaggaagaaggaggaggagaagaagaagaagaagaaggagaaggaggagaagaagaagaagaagaagaagaagaagaagaagaagaagaagaagaagaagaagaagaagaagaagaaaagaagaagaagaagaagaagaagaagaagaagaagaagaagaagaagaagaagaagaagaagaggaagaagaagaagaaagaagaagaagaaaaagtagtggaggaggaggatgaattcatttggtttttgggaaactctctctatttcccttctttttctcattttgcctcagatctgattttctggctgtggtcacagcaggccagcatgtggacaaagggaaacgcctggtgtgaaggtgttagttttgacagtgaattccaagtagagaagatgaaggggaaaggagacttcgtgtgaactcgatgatcatggatttcacttcaaatacaaaccatgtccagctaattgtggccaggtgaggggactggccgcaggtgaccaggtctaaaaccctttcaaacgaagttggaaatgtgtttttttatataaaaggccgtgtttgaaaatattaccaactacttcaatgtttctttttaaaattatctggggggcc

SEQ ID NO: 461094 - DNA, 1815 bp, Homo sapiens
tctgagtcaaccctccatacgtccttcatgtcagggtgggatccaggactgtcgagccaagtgccggcctgtgggtgtcctgctgtgtgcacgagaaaacagggcatccttagccacatccccacaccccactgttcccagagaatgcacacagggcagaggaaaaaaaatgaaaacaagagctcggcaaaaccaccacaaaaaagggacaaatcctcaacacaagcaagaatctctaacacacttggctcagaaaatgacagaaccgtcataacacaagtaaaacatatgataggactgaatatcactattgagacgctgatgtacagcgcatataccaggatgtgcagaatgaagattctattactgaagaagccaccacttgcaaccctgagacaaccacgagcagaagctactcagatccagaccacaggctgtttttttcagccccaaacccacatgaagaacttatttccagacagctcctactcttatggtggctccagaccctgccccatgcagaaggcacttctcaagttccaggaccagggcttcagccacagcactcgcaaaaccccacagatacagtgccaatgacagaaattaagattaactgggggcgacacagatttctgtgaatgccagtgctgtcagatgcttcctgatagtactttctagagtaaaagaacttcgggaaaagtaaaagcagcaaatggtaacaccctcatggagatctcagggctgcagaacaagcactttgagtgctgaagacttctcccatctccacgtccctaactgtccccatgcagattccaggatccacacatcagaggcatctgccactgagctgggtgtgaaatctgaagaccagggtgtagaggcaagcactgaaggcccatgatcagccgtgggagccacgggaatcaattgcttccagtacgactggatgcatcggaaagagcctggggcaaggctggaggccacaagaggagctgccaggccacataagcagggaacaaagccgatgatcacacgcccatcagtgagccaacttggtgaagggaaatgcccaagttctcagcacctgcagagcctaagacataacaagcagcatgccctgacgctcaccaaggccaggtgctgtggtgagtgctctacctgtttctgtacagaagagaaatcagaatgccagagacatgaagaaacttctccagggtcatgtaatcaccaaataatgtctgcttcgaccatctctgcattttgtgctacaccaagatttaagcagctgttcaaaggaactgtagaacagatgtcacagatgtaactattcttgaaaggaagtcagatttcatagatggaaagactgcccttttccatttgcctcctccagacccataactttggataggggggttttattgtccgtgaggcttatgcatatgtcagaagaatgtccaagcagaggaatctaagtggcagaccccccaggataggaaagaagaaggacgctcgtgctgacacttccagaacactcttcacgttttgtgacatatgtgcttgtcgagtgatcttaagacagctggatgtccgaaccatgcagtaatagcagagaacctgcggaaggagaagcttcccaggacgttctgagggcttatgccgggtgcaggctttccttcccgcaacatccctgagtccagagaagaaataatcccctgccctgtgggccaagcacttacagcaacagcactttgagtttgctgtgcttagattcacttgtggaacttgttaaaaatataaaattccagaccccacctc

SEQ ID NO: 461095 - DNA, 1482 bp, Homo sapiens
ccagcatcaccacagacatgtgagtaatgtgttgtgctacattgccttatgatggctgcgatgtcactaagtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaaggtcagtgtttgtttcactttctgtagtaaaaccaaaataaaagtacaagtattctttattctatgcagtgattcactgattgattactgcagattatcctgtaactagtgtactgctgtcaccgagttagcatttttactctcagttgatgcttctatcctaggtcacaaaatttatgtgaggactgcctttgccctactgttgcagctcaagttttataaagagttgccttctacactcactctccctccattatatacctctgtatgttttgcattctcatagcttagctcccacttataagtgagaacatatggtatttggttttccattcctaagttccttaacttagaataatggcctccagttccatccaagttgctgcaaaagacattattttgttcctttttatggctgagtggtatttcactgtgtgtaaatatatatacatatatttgtatatggtgtatatatatgtggtgtatatgtgtatgtggtgtgtatgtataccacataaatatacaccatatatatatacacgcaccacatacatatatacacatgtgtgtatatacaccacatacatatatatgtgtgtatatatatgtttgtgtatatatgtgtatatatgtgtgtgtatatatgtata

SEQ ID NO: 461096 - DNA, 583 bp, Homo sapiens
tctaatggaaatgacttcgttcagctggtgaacattttggaagattccagaaaaacatgaacaagtgtttgagtgctcttaaggggattgtctaatatcttggctcctgactcatccttagaagtcttccagccaccttgtacccatttcaagcccaagggctctttaacgtaaatgagttactgagcagagtgttgctggagatggccactggagaggctgagtcaaatcaatctcctcacctgaggacttcctaagaccagcgcactgaaggaccagcagcaacaacaacaataatgctaatgctcccttatggacaagactgcaattctctgcctgctgaagctcagctatgaccacgtgacttgccttggccaatgaaagaggaagagtatgtaacactgctgaatggaagcaagtggcccctgcccctgctgcagagattctagacatgtgtgccatgctggagcaaggagacagggagtcctggagaaaggagacatggaacagagctcccagcccagtcaatatgtaacatgagtgagaaataaataacactttgttgctagaagttttttttaaa

SEQ ID NO: 461097 - DNA, 649 bp, Homo sapiens
tctaatggaaatgacttcgttcagctggtgaacattttggaagattccagaaaaacatgaacaagtgtttgagtgctcttaaggggattgtctaatatcttggctcctgactcatccttagaagtcttccagccaccttgtacccatttcaagcccaagggctctttaacgtaaatgagttactgagcagttttctctccaggaaaaatggcttttcatgacagtttgagtattgcacatgaagcatctagcaaagcctcaagcacatgaaaagaacagagaaagatccagtgcaaaaactcataggaaatgatcaattcatgccaagtgatgagaactagagaagagagatgagagcattgttcatacacgatggtctaggtctcctaccccaagagaacttgcaacaaagcccaaagtacaacagccacgtttaaagagaagattccatttcagccagacaacatgattcatcatatttatttaatattgttaatttgaattttattagatctgtactgatgtttgtatttaatttctaatttgttttggtttcataattgactaaaacaataagcacaaagagtttctatctgactttatatattaacattttaataaaagtcttttatatactcattgggatcca

SEQ ID NO: 461098 - DNA, 1111 bp, Homo sapiens
tctccctcatcatcatcaccagcactaccaatttctctgcactatggatctagatggtattgtctccctgacatccaaatatcttcaatcatataaccaagccatggttcccatcactcttcaaacccctgagcattcaagcaacccaaggaagtcagagctctggaatcttccaggaatcacagtctctaaggcagatggaatcttagaagaagtagaggatcctatgtggtgtttgaaagttcctccttctctctctttctccctcctgctgccttgtgaagaagatccttccttccccttcatctttgccgtgactgtaaacattaaacagcactgcacatggaaagaagccaaagtgtttgataattcatcagcagcagcaaacctgagtgtttctgtgcaatgcaaattgctttggcttccacacagctcctgtcgcttcaagtgcggatggtaaatagccttccttgggattactatcaagtattcattttaacaacattaatttacaacgtgctatcccactttacattgtgctacatgacttattcacagagccagcccttcggcgcctgatgttgattcattctaatcaccgcacttgcctatgatttttaggttaatgggacctggactggaaaaggattgtttgtgtgggaatcattcatggcaaaggcagtgacacctccttcaaaaacctgtgtctttctggcagagtgttgctggagatggccactggagaggctgagtcaaatcaatctcctcacctgaggacttcctaagaccagcgcactgaaggaccagcagcaacaacaacaataatgctaatgctcccttatggacaagactgcaattctctgcctgctgaagctcagctatgaccacgtgacttgccttggccaatgaaagaggaagagtatgtaacactgctgaatggaagcaagtggcccctgcccctgctgcagagattctagacatgtgtgccatgctggagcaaggagacagggagtcctggagaaaggagacatggaacagagctcccagcccagtcaatatgtaacatgagtgagaaataaataacactttgttgctagaagttttttttaaa

SEQ ID NO: 461099 - DNA, 812 bp, Homo sapiens
  misc_feature (3)..(3): n is a, c, g, or t
  misc_feature (5)..(5): n is a, c, g, or t
  misc_feature (7)..(8): n is a, c, g, or t
  misc_feature (10)..(11): n is a, c, g, or t
tgntncnnanngtccaggaaactttaaagtacagatttctcccacatcttaccaaattggctgtgtctcccaagaagttatatgcgggctaataaagcaaacagtgccgagagcatcccccatgtggtcagccacacagacaagcacaatcgtaagctctgcccagcctctgagcctgtcagctcctttcagttactgcactgtgaacattacaaacttgccaagcatcacgcacagctgtgcagctggcccataccaaggcaggatgccaacccctggacatgggttggggaaaggtgggaagaggctcaaagcatgtatgatgttagctcctataagcctccaaacatggactaccttacccttgtgtcacccacccgaccacgccagacacatcgttggtattcaataagaacacccatgatggtgtccttaaacatgatgctcttctggctgaatcacatagggacaggccctgcactgaggttcaagcgctggtgtgccatcggggcagggatccctctgacagggcctgtcagggattgtgaaattggaaaaagtcacaatagtgttgcttgttccccagctcgctcagtaaatactttacaatgtgggcacacatggataccttggagacttgatggggaacatggccggggaatcctgcccttcagggagctgagacattatcagcacacacttcctacttcctcagaaccatccagtgatccggaagaaaagttctcagaacttacgtcattggtagagtaagctttttgacaaaagctggaggaagaaaactattgtgggga

SEQ ID NO: 461100 - DNA, 1237 bp, Homo sapiens
actatgtcatgtgaaaagtagcttgatttggggtcactgctattcagtggaaaatttaaccttgggatggataatgcagcccaaatttgaactctgaaagactattcactggattggaagaccaatagataccaataaattaaaagtaattgctgtttatccttcatcaaaattaccattattctacaaggtggccctccagagttagtgaactgtgacctccacatgggatttggacatgcgtgccctacatctggaatgcagaaacactcttcacagaactctgatagcccaggaatatttatgtaaatctctgtcctggtaaggcacatgttgatgtacttgggcttaagctcataaaccaagaggaacagtttcctacatcccccttctaatgactaaagccaacgggctgagccaaatgggacaatttagacaaagagagactggcgaaaagcaaatgaatgtctgcttccttctagcattctaggaaaaataccaagcggctgtgccaatgtgcactgcttgcctttgttaggagaatacactcaaaatcaggggaatcagtcagtaccaggttcaggaaagatgtatgcaagagagactccctgatgaggaaaaatcgactacagaaacacagcatgcacccagctcagcacaaacacagcttaaaaatccaaggaattaggatgaagtgtagaatcccgaggttctcattcttactagactgtgatctggaacacgaatccaaaagaaccacacaagttgtttttgattactatgtgcagatcgatcaacatgctgattactcgaccggtcatcagcacctcttaccttccaatattttgttaataaatgttgtacagcagcacagcgtcagaaagaacttcattaaaggacaccccccgaacaaaagaaatgtccagcccagaacgcccccttctttcgtgagaactatctgcaacacaagaggtgaggggcagaagtatcggtcctgctttgaagatactcaggggagttgcgaagaaaatgcaaaggagaccgtaactctgcacactgtgatgccagttgcatcacattctgtgcttgatcatcccactcttataacccctggattttgcaccaacttggggccctggatgcagtgatttccgtcagagatgaccaaaggagtgctcattcattcattcagtatgtagggaacgccttttaaacgctgtcgttggtcagctctcct

SEQ ID NO: 461101 - DNA, 411 bp, Homo sapiens
actatgtcatgtgaaaagtagcttgatttggggtcactgctattcagtggaaaatttaaccttgggatggataatgcagcccaaatttgaactctgaaagactattcactggattggaagaccaatagataccaataaattaaaagtaattgctgtttatccttcatcaaaattaccattattctacaaggtggccctccagagttagtgaactgtgacctccacatgggatttggacatgcgtgccctacatctggaatgcagaaacactcttcacagaactctgatagcccaggaatatttatgtaaatctctgtcctgatgagaaaatgtaggccacaaaactttcctgacgctcccaaagtcatccagcaagaagtaccagaatcaaaatcttcttatccttgcaaa

SEQ ID NO: 461102 - DNA, 1064 bp, Homo sapiens
gcaaaatcgggtgcagtaaacccgaaaagggggcgaggaggcccgcgaagagagcgggggaggaggcggggaggggcgaggaggggcggggagggccgagcgaggaggaggcggctctgggggccgggcggcgcgcctgacagaggaggggaagcctgggggcgcaagcgtcgcagccgaggggccggcgcggggaggcgggcgccaggcgggggtttgcagggccgccgcgcgtgacgtagcgccgggcagggcgttatcagctgccgggccgcggcgagggacgcgcggcgacagcggacggcgctgcccgggccgggacagcagcagccggcggtcgcgcgcaggactcgagggcttctagccaccgtccccgccagcgccgcgccccgccacagggcggcatgagcccacccgcggccgcagccctagcgccctgctcctccgcctgggcggcccggctgcggtgacggctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattgaactgtttgaggcgaagagatgctggtttgttgaatcagttgcaagagcttgacaagcagataagtgacctgagactggatgtagaaaagacatctgaagagcacctggagacagacagtcggcctagctcaggtgagtgattgagcacaaggacagaattctgcactcttgagttgtatctcagccccttgtggttaacattcccagacctgcaaatggcaa

SEQ ID NO: 461103 - DNA, 339 bp, Homo sapiens
cttcctgttgcctccctcagccccgcattcagtcccgtcaggagtgcagctgggctccagtccgccacatcccctcgcggagcccccagtgccttatctagaaaatggaggtaaatcgtccctacttggggggcaggacgagttcaataaaatgggacacgtcgggcgtctaaacatagcgtggggcccacagtagagcccggcgagtccaaccagtcagcctcgcactgagagggaagcgcgcgccaggccccgtttccagcctcctgtaagtcctctctcacgcacggttcaccgtatcaccatgagtatctgccaagtcatgtatgcctgcgatga

SEQ ID NO: 461104 - DNA, 403 bp, Homo sapiens
taaacatagcgtggggcccacagtagagcccggcgagtccaaccagtcagcctcgcactgagagggaagcgcgcgccaggccccgtttccagcctcctgtaagtcctcccggaagaccagttcacagctcattggaagatcaaccaggattgacaggttcccagcccaatggctggccgagcccgagaatggctcgggagcaggtggtcggccccttcccctctctggggcctctacctgcggaaggcagggcggggggcctggtttccacaagctgcctgtgtcagcctgtggggccggccgccccactgatgactcaggtctcctccccacccttccccttcaggaagaggccctgtcataatcgcagttgtactacataaaaatagcttcgtttcacagt

SEQ ID NO: 461105 - DNA, 982 bp, Homo sapiens
cttcctgttgcctccctcagccccgcattcagtcccgtcaggagtgcagctgggctccagtccgccacatcccctcgcggagcccccagtgccttatctagaaaatggaggtaaatcgtccctacttggggggcaggacgagttcaataaaatgggacacgtcgggcgtctaaacatagcgtggggcccacagtagagcccggcgagtccaaccagtcagcctcgcactgagagggaagcgcgcgccaggccccgtttccagcctcctgtaagtcctcccggaagaccagttcacagctcattggaagatcaaccaggattgacaggttcccagcccaatggctggccgagcccgagaatggctcgggagcaggtggtcggccccttcccctctctggggcctctacctgcggaaggcagggcggggggcctggtttccacaagctgcctgtgtcagcctgtggggccggccgccccactgatgactcaggtctcctccccacccttccccttcaggaagaggccctgtcataatcgcaggaagaggaaggcagtttccccctacgcgttccccgggtccctcttcaaaagcggatcctcgggtgggggcttcacacttctcagcaatagcttcatcagcggcttcctccccggcttcggcgctgaaggctttttttaccgctttgcgaccagcttctcaccttttcttatttggccctcacgaaagtactgtggccacagccagggcaccaagaaaaaggagaggcgaggaaggctggacggaacacagatgtgaggggcaagacattcatgcaacaaacatttgtctggccggacccaaggccacaggctggaaggaaatggaggtgggaggggcccagaaaagctgactaggctggaaggctggttgggagggaggaagcacagaaaggccagcccagcaatttgggcaaagctggcaaggctgccttggcatctctgc

SEQ ID NO: 461106 - DNA, 921 bp, Homo sapiens
atcccacgaggtaggcatcaatatgcccattttagagaagaggtcactgaggtccagaacagctaagtatctgcaaaagcagagattgagatttgtatctttaagctacaattcaaaactttgtcttattcttaaaacacatgataatatacaatcacctccagtggagccacctaagcccccagctgccccagctacttccatactttcgtctcccaactctgagtctccacaatgtttgcctcctacatcagatcccaagttactcaggatttatagaactctcaggaaagcagtgaatctctaccccttcccctacctgcagagaggcgtcctccagcaaggaagaccagcttgtgccaaggcccagcggagacaagacacaatggggtatttccggagctgcttatacttcagcatgacacagcctgacaggacaagccggaccaacatgcagggaaaggtgaccacaaagccaggtgtgtgaagggaatgaggaaggggattgggcaggtgctcactgaagaaagacatctccacaggggccagcccaccaacgaacaccttcttcctgattccagctgagccttggaagccagaaaagtgtagggggcagaggaaaacttcccctttactctctgattgttcactgaaaatcaacagaccaaaggcagattaagagaagaaaagggagaaagccctaagacctgtgaaaatgaagatgtgctgtctgactccctcagcctgcccacagaagcaattcaaaggcctcaaataattgtctcaaaagaagcaatttggagaaagtacattacaggaggaaagaaaattgcctaatcctcattctgctgagtcctcaatttgcaaaagctcggaatcaaaataatgaggaaataaacatgagggccgttccagggctgg

SEQ ID NO: 461107 - DNA, 2063 bp, Homo sapiens
agtgggaaattgtggatgagatgctggaagcccacaaaggcaaaggcaagtcctcacttgctgagaaaacaaggaatagtgagagttctctggtccctgggagctatggtgggaaagctcataggatgaatgctaagactcagctcctgtgggctgcgtgtgttctgactggtggtcctggactggtctcatggggactactcttccttttaaagcacatttctcagatttatccccaactcctgctccatgttccctcagatccccacagttcatcatccttcctctcccctagagacagcaggaaagactttttctgtaaataccaccaggaatgtggagaatgggaaagagggaaacattttcattttcatttcttttacatctttatttgtatgataaacaaagagaaaaaaattcacattgccctattaaagcattattcttatctcgtatttggaacctaactctaagggaacctacataataatacaccttgacacaatgcgcaccaaaattctgtgctttcatgtgtaagaatggtatgcagatgctccaagaagtgggaatattttactataaagctgccccatgcagctttgtgcaaacagcaattgtgtgcacttatacaattagtcataatgctataagatgaaaactttcctctcattttttttaaagaaactgtcttagtgacaatgcagaatactgtcgaaagcagtacctaaattgagcagactctcagactcaataccttttgtaagattcagtgaaatttttctgctcttactttggggagaagaaattggaaaattactgttagctgacaaagaaggaaaataacagtgtgtcttagccattagcatactaccaaatcaaggtgtttatttcaaaagagtcagaacatctagttctaaaagttaggcttttttgaaaaaaagtagaatcttcaaagacaataatatatgtgttcacagcctgcatcttagtgatgcatttgtgggcacgttcctatcatgttaatgaggcttttgccactgcatggccccagtgacagttggatccacgaacagcagttcatcaattgattgcaggtgtttccccttggaaaataaatactgcgtgttcataccaggaggtgagggaaaatcgattttcaacagccacacaatctggtgagttctgaaatatggctttgggaagcaaattctcttgctgctggtttcatacataaatacattctatttatgaaatttagagccaaagacagcaatagtaataaggattcataaactgaaaattaactgcagtacacctagaaagggacaaaaccttatttcctaattaatagataataaaatctgaaaatattaaatgtcagtatccataattatccttttggaagtcatttatatccacattgtattaagttcctctctaaaatattctttatcatcaatagaagaacaattcaatgaaaaagatgcctaatttcaatttaggagcctgcccagtaatgacaagccatgaagggtttgttcattattccatgtcatttggattttatgcagagtctttgtaaaagtgacgtgaagagattttcatgttggaaagatgactaactgcatcgtagaattaatgtgaaagggtggcccaaggaagcaagtttcttcacagctattgcaataaacagggtctactggagaccttggctttttatttccctgacacaacttcacactgctggagcaatgcttggattgctctggaaacactggcaaatctcaagatgcagttcaggcttctccatgatgagtgtgagtccctaggctgtctctcaaactaaagattccccagccaggcaactctaaagagtcttcgacaaggcaacacaattactctgtgtgcttagaagaagaggggtcataaatgtcagctgttgctctttgagtcctgctaattcattcattgattcactcatctttcccacaggcatgtgctgtgcgtttactgtactgcatgacactgtggaggttataaagaaataaaatatttggggctta

SEQ ID NO: 461108 - DNA, 1415 bp, Homo sapiens
ctcctcaagcgcggccagagtgggagccaaggccgaggaggcgccgagagcgagcgagggctgtgagggttgccagcaggctgtcacctttcactatgagaccagtcagtcatcccttgtgacattaataataacttctaatccagtggcacttgatggtaaaggtgcctgccccttgcacagcccagaggttatcgactggaaagcggcattgcgagtctggtttaattttccgccgcattaatattaataggaaacagttggctctgggtgcagatgtggagaagatgcacaggaacaaaggctgcctgcagttcagaaggttcaacgaaaccgttaacgtaaaacctttagcacattgtcgatgttcgttacaggtagctatttcaacatctggaagtgtgtgtagaaggaagccatggcctgagtgtggccagcaagttcttgtgatcagccaggtcctgaacatggctggagggcagggggagcagaaacaagcactggggacaggaaaaggaatctactcatatgtgaggggtatccggtttgctggggctgctctcgaccgcaatcagtgttcatcatctgggcatttgtggcatcctagccggggatgaggtgctccagataggtcccagggccaactggggtcagtcgcattccttgactgagggtctttgctcctgctttatgaccctgcactcacaggtttctctgtgtccagattttgataattgctccctcctcctcacccctccaggcctaaggggacatgctacagtaccaggtgttatcaataccaactcacattcctttccttatttgaaaaaaagactagctctctagctcattacagacaccccttcccctttcccctctctcttacgtgcccatcttatctaaagaaagttcaaatgtttagccaaccagaactagtttagattgcatttattcgtgcagggtagtgaagatacaaaataggcacaacttctgactgtgagaaacacagcagtcttcaagccatccttctgggctgaataactctgtgtgctttactcccttgggaacgggcttggaaatggtgacttgtaagccctcctcactgtgagaataaatgacccagctcagcaaacatttaccaaaccccgactgtgctggaccaagacagacggaagggctcagagtcacaggaaaatagccacagctaactttggaatctcattccttatttaacattatatttacagcgataacttgggaggcaaataaagctgcaggagaaagcaagaactgtggatcagcctcaccgatttcagctccagggcccccactggcaccctacccgaacttgcggaatgcccttataccccagaggaattttctcatctgtaaaatgaatataacaagaaaggaaa

SEQ ID NO: 461109 - DNA, 2004 bp, Homo sapiens
acaccatatctgctcctcctctgctcacaggattggtgagcagcgagtggccccgagccatgagccacctgagtaggagacctggagtcggccttgcctccccctcctcctctcctccgcctcctcctcgcctccctctcctcctcgcctccccctcctcctcaccttgccctcatggccatccagttttgtggcttccacctgcccaaggtccctcagagcgctgcctctacttctgtcgcccacctcctcttctcttcctgaactagtgcaacagcctcctttctggtcttcacaccacctacaggataaagactccaagtacctccatgaccaaagtcccgccttctccccagccttgtctccagtctcctgcacttattccagtggccccaaacagtcctgatcccagaaaggactctgtcctctcacctgccagcctgcatctcaaacatcgcctcctctgagaagcggccccatgcacctcccgcaatgttcccatacgagccagtgcagccatcatcagggcacttgccaccggaggtgtggagggagaggcacgagcaggaacccgggctgcgcgcggcgcttgtgggccagctggagttccgggtgggcgtgggcttggcgggccgcactcggagcagccagctggccctgccggccccaggcaatgaaggacttagcacacgggccagcggctgcagagggtgtactgggtcccccagcagtgccagcccacaggcgctgtgctcgatttctcaccgggccttagctgccttcccgcggggcagggctggggacctgcagcccgccatgcctgagcctcccacctgctccatgggctcctatgcagcccgagcctccccgatgagtgccgccccctgctccacagcgcccagtcccatcgatcacccaagggctgaggagtgcgagcgcactgcgcgggactggcaggcagctccacctgcagccctggtgcgggatccactgggtgaagccagctgggctcctgagtctggtggggcggtggagaacctttatgtctagctcagggattgtaaatacaccaatcggcactctgtatctagctcaaggggagtgggcatcagctcagaaagaggatcccatgggaactgactttgctggtgaccaaggccctaccaccagggcaccctgcccatgtatcccaagcagagggagcagaaccagcggtgtaactactgtgcttgacacccagggcaggtctttttttaactcaccgatcttccatgcaacaaaattgttttctgtgaaaagcaggaaatgaataacaacagcgtaggtactccacttcaaatttcccaagaaattcagaagaattgtgaacaagttgctggtttcacaatactgcaagacactgcaagttattccaagttcctacaggacaacgatgcacaattatttacttacttatgtttaaatatacctatcagtttgactttcatcctttggtgacattctaataatttatgtaaataattattcagagaccaatgagaggattttaataagtgcaaaatgttagcagacggtacaacattgataaatctatggtctgtattttgttctgccatttcaaaataattaaaaagtaagtttcaatttaaaaacattattgaaattcagtaaaatatttcaagcatgaactaaaatatacacttactaaacacaaatattacatctcacatttcatactctgtttcattgttttaaattttaaacagaaataactccaccggccacatagaatgatcaaatcaggcaactcaagttactttgtttcatcttcacaatcactgtgctatcattgttcattttgaatctactttttaaaagcaagaatatttgataccagataccagacacaaattatacctgaaaaggatgtcattttaggatttgtgtcccacctaaaggatacaattctgtaccctgacaatgttattctagaaataaatgcct

SEQ ID NO: 461110 - DNA, 715 bp, Homo sapiens
ttattaacccgggtcttctgcgcccaaagactcagcctcattcaggaccatattatgttcatacttctgctgcgtccaaggagtgttgacgaaaaagtggggccttggaggggtagaggccaagggacagtttcccctctgccctttgaagttcacgatcttccatgcaacaaaattgttttctgtgaaaagcaggaaatgaataacaacagcgtaggtgcgttggctatgtccggtggcatttcttcagaattttcattaatgacacctgattttggaggcattgtatatttttaaatacatccagatgttgtttcagttgcttcctctttggttctttttgcttttcgttgttgagcgtcacttaaattcgtgtcatttcatgttggcgggtactccacttcaaatttcccaagaaattcagaagaattgtgaacaagttgctggtttcacaatactgcaagacactgcaagttattccaagttcctacaggacaacgatgcacaattatttacttacttatgtttaaatatacctatcagtttgactttcatcctttggtgacattctaataatttatgtaaataattattcagagaccaatgagaggattttaataagtgcaaaatgttagcagacggtacaacattgataaatctatggtctgtattttgttctgccatttcaaaataattaaaaagtaagtttcaattt

SEQ ID NO: 461111 - DNA, 1647 bp, Homo sapiens
acaccatatctgctcctcctctgctcacaggattggtgagcagcgagtggccccgagccatgagccacctgagtaggagacctggagtcggccttgcctccccctcctcctctcctccgcctcctcctcgcctccctctcctcctcgcctccccctcctcctcaccttgccctcatggccatccagttttgtggcttccacctgcccaaggtccctcagagcgctgcctctacttctgtcgcccacctcctcttctcttcctgaactagtgcaacagcctcctttctggtcttcacaccacctacaggataaagactccaagtacctccatgaccaaagtcccgccttctccccagccttgtctccagtctcctgcacttattccagtggccccaaacagtcctgatcccagaaaggactctgtcctctcacctgccagcctgcatctcaaacatcgcctcctctgagaagcggccccatgcacctcccgcaatgttcccatacgagccagtgcagccatcatcagggcacttgccaccggaggtgtggagggagaggcacgagcaggaacccgggctgcgcgcggcgcttgtgggccagctggagttccgggtgggcgtgggcttggcgggccgcactcggagcagccagctggccctgccggccccaggcaatgaaggacttagcacacgggccagcggctgcagagggtgtactgggtcccccagcagtgccagcccacaggcgctgtgctcgatttctcaccgggccttagctgccttcccgcggggcagggctggggacctgcagcccgccatgcctgagcctcccacctgctccatgggctcctatgcagcccgagcctccccgatgagtgccgccccctgctccacagcgcccagtcccatcgatcacccaagggctgaggagtgcgagcgcactgcgcgggactggcaggcagctccacctgcagccctggtgcgggatccactgggtgaagccagctgggctcctgagtctggtggggcggtggagaacctttatgtctagctcagggattgtaaatacaccaatcggcactctgtatctagctcaaggggagtgggcatcagctcagaaagaggatcccatgggaactgactttgctggtgaccaaggccctaccaccagggcaccctgcccatgtatcccaagcagagggagcagaaccagcggtgtaactactgtgcttgacacccagggcaggtctttttttaactcaccgatcttccatgcaacaaaattgttttctgtgaaaagcaggaaatgaataacaacagcgtaggtactccacttcaaatttcccaagaaattcagaagaattgtgaacaagttgctggtttcacaatactgcaagacactgcaagttattccaagttcctacaggacaacgatgcacaattatttacttacttatgtttaaatatacctatcagtttgactttcatcctttggtgacattctaataatttatgtaaataattattcagagaccaatgagaggattttaataagtgcaaaatgttagcagacggtacaacattgataaatctatggtctgtattttgttctgccatttcaaaataattaaaaagtaagtttcaattt

SEQ ID NO: 461112 - DNA, 4961 bp, Homo sapiens
tgcaaagggagacactgagtttcagacagctgcttttgcacagtatgaggcagcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacacccttgccctgcccagccccaaactcgaactaaaagtaggaaactccctgttcctagacaagcgactaaagcctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaagccaagtggaagcaccctttcagtcgctaccagacccagaagcaggaaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggagctgctctgcagccacagaccctgagaaaatggggccaattgctcctgcccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttctgtgaacactaaggagcaatccttacaagggaggaacagcttctagccactcattcacaattgtcccatatctggtgttagttgtgcttagaaagttgaagatgagaacgaccctcatgttacagcctcccaggagatgtccaccgctgctgccaccattgtagatatttgttgagcatcctttgggtaagctttaaataaagagaaaagggtaggatagtctgggagagggcaggggagagatgcgatcggcaaaagcaatgggtaaagagaggaaaaggtatgccccaataaaatgagagaaaaccagctttgcagccatggaaagttcagacaccattataagcagttgacagatgtcaataaactttctatttccaacagtcatgagagggaggcactgctacatctttatcttacaggtggggaaactgaagcaaaatgtgctagcatgtgcagagcctggatttgaacccaggctgttcatctccacagcccacatgtttcatctctatgccacacttcttttgtgagcacaactcaaaagcccttcagccacgcctcattggctgccataccacaaggatccaactcccagggtcataggaagtgggagagggaagaagccacatgagcagtagcatctggggaagactttctagggaaagacccagaagcatggatggaaagttggtggtttaagaagcactgattgaggacagggatgtgccctttgttgtttatttctgtattctagtacagagactggcataggataagtaaaaaaaccttttctaccttaatgctgtgaggggaagttgtgtcacatggcagaattccatgacaaagactcagaggcaggaaagaaagcaccctggtgaaggacatgatataaaggtgcactaagttttgggagaaaacttagtgggagaggccccgctctactccaagctgtgtagacagcactctctctctctttggcctcttcccttcctttctccttgggaagccagttgaggcaggctccctggactctagtaacatcttacacccttcagctggctggacaaccttggacacattgctcaacccctctgtgcctcaagttcttctgcaaaatggaacatgcaaaccttgctttaaagaattgtggaaatcaaatgaatacataaatgtgaaacattaagcacttgaaatccactaggtgctcaatgaagcttccttctggccccatcttttggctcctccaaccgtcaagggtgctcttcaagggtgctctttcctcccacagagcagagttccgtaccaggtaatgccaaaatccccccagtggtcactggccacataactacctcccagcgaaaccatgaaggctgcacatcaaaacacaaatgtgttgatggagaggcctcaggggccttatctgggcactaaaagtgacatctgcaaaacagaaccattcttgctgcaggaacattagctatgacactgtggcactaagtgggggaacgctggcccagggatcagggctgaaattgcagaggctcacgtgaaggagagccacatgattttctctagaaaagcatcattgttagattgttcactgggtttcttctcctttttctccctaagataactccttcagtcatctgtgaattaggtaagagtctccctaagcgtacatttcagatgtatttacactccaaaccaaccttttaaccacctagaagaatggaccattttcaagataagtcaacagccatctaaaatttatattttcagagatcttgcgatgctctctgtggtggaattgaaccatctttgtaacgccatagagtcccaggtatatttattttgaccctggaatggaggtaaatggctttcaatgttgggactaatgccctggccagttacagccaatatgaacacacaggtccaagtaatgaaaatatcactagggacactggtgtctgtcactccacctcaaggttccatgtgtatcatagagaccatgaaaatattcataaaatttctattccctttattctggccatgaacagagctgagacctttaaagttttctatgtatgggtgggtctgtttctagactgtcatttacaattctattgaatgatttgtctttccttgtgtcaatactacgctgtcttatttaacctagctttataagtcttgatattatgtcaagtcctccagctttgtttatagaagtattttatttgcttatgttgttttgttttgctttcaatgtttgttttttatcctgcccactccaccaattctggttacagtggctggtgactctgtttctccagctgccccaccccttctcttcccacacttatataagcctcaagtcctatgttaaaactttttatttcacgaagtatttggagtgtctctgttttcctaacccatatgaaaacatctttgttctgccttcatgcttgaaggatattttcactgggcacacaattttagatagccagatgttctctttcagtgttataaagatgtcacccattttgactttcattatctgagttaaaaagttatctataattactattattatcctttgcaagtgatccacttttccttttggctgctttaacatttttctctttgtttttgtctttcaattgttttcaaatgatattcctaggtatagttttccatgtatgaatcctaattaatcttaatcttaattaatcctaattaatattagggttcatacaccttcctgaatatgtgacttgatgtctgttttggaaaatagatactatctctttaaaaattgcttctattccattttctcttctttctctgggacaatcaaacatatatcagacgtcttcatcatgtgtcatgtctccttcacacttttctgcattttctattcttttttctttccgtgtgtaatctggatgctttctgcatgcctatcttaaacttctagtcttttctgctatgtttgatctgcttttaaataaatctatcaaattcttaatttcagttcttttgatttttagtgctcgggtttttattttactctttttatgcatttttgttctctatgaaattctttatattttgttccatcttattacacagaatgatcaaggttgttttaaaccctgtgtttgataactccaatatctggatcacctgtgaatctgtacattctattctatgtttttctcttggtgtttaatcagtttttctgttacctggaatgcctggtcattttcactgaatgccacaaagtgtgtatcaaaaattatgtggctttgggtaatactatcttcctcaagaggagaatttattttcttctcaggcagatagagtataaaaagactactttgattcagccaaggatggatttcagtcctttgggggtctggtttatttcttttgggccttacccctataatgttgtctttgggagatgtcaactaagagcctgggctatttgtgagggctcctccccgttaacatgtttatataccaatttttgtctcttcccttctgtgaggctgctaaaatctctgctcttctagcaggtggcttttgcatgattatttgctgtctcattcc

SEQ ID NO: 461113 - DNA, 667 bp, Homo sapiens
agaataccatgatggtggatatgtcgtttttgtaagaccatggatgatagttttggcagaatcactgtacacgaggaaagcaaatccatatccagattatttattctgttgtccttattgacgggaatagaggaaaaggcacctgccagctcaatagctgcataccagagatatctggagggagagcatccagatggaagggacagaccagacaaaggccttagacaagagactgctggtgcatttgaggacagcaaaaaggccctgcagctggagcacccaaagtgcctaactcatagaaagagctcattagatgctggccatgatggtagtgatgataatgacagtgaccagagaggcaaatttaccttaaagagcagctggtgcttaatggaaaattttgagaaagttgtcgttatgaaccaattcaatggctggagcatttcctgcaaaggctcttatctggagaaagaggatttcaggattgtctgcatgtcaggacaaagcaaagaagaattcagcaactgctgcttaaaaactcattcactactttagaaatcgagacaaagtgaaagacatggatggaatgaattcagcccctcctcctattgtttctctagcaagaaggtgaccaaagctataaatgtttgtttcctgaaaactaaag

SEQ ID NO: 461114 - DNA, 599 bp, Homo sapiens
cgccgttgtgccgcgcctgccgtcaggccggggatttggagcagggatggggggaatattccagggcggcccgggagctgggagccgccggcccccaagcactgtgctgggccaggagagtgcgcatgcgcgcggcgacctgtgcgctcgggttctgtgccggcttttaccccagctgaataacctggtggtcacaagaaagcaaagggatttttatgtgacatcatcttggcaagaagctcccttaccaaccttgacctccaggtctccatggcaactgctgctgggacatcattggcaccagattgtgtcccttaaaggccacactgcagcaagggcagataaacaatttcatggcaacaaaccttcaatatgggacacttgctctagaaatcagccaccatcctgtgagaagtccaagccacagagtgaggccagaaatagttgctgcagtcaagagccccagctgagctctcagccaacattcagcatcactgccagccatgggaatttccaagaacccttcaccctcttatgagaaaaagaagcactgaccaggctatatctgtggctaagacctagaggaaaagacttgggtt

SEQ ID NO: 461115 - DNA, 1677 bp, Homo sapiens
ctgttgtgaaacgattcatactgcaagccgcctaaatgcagggcttttgatgatattccccgccaacaaggcatgaaggtggggcttgcctccatctggctctcctgccactttcaacaacacaccccacatccgatcctgcttagagtcgaagatgaatctggcataatacaaacagcactggactggaagcatgaagtttctcttatctgtgccttggtttcctcatgtggaaaatgaaaatgttgacataaataatcacacaggtctctgttagtaccattttgtgattttatatcgtgcttaccacacctagaaacaggggccatcattccagccagctaacagagaaaaagacgatacataatcaggcttgggaaaataaatttcagagaccaagtaaacaaagacaacaatctagtataagggttataactgggggatgaggggttgcaaatggagatctgccacagtcaactctatttggattcccctgttctcaacaggcaacagcaatcataatgggcttggagcaccagtcccacaacatcacaggacatccagacataattgcattaataatgttgtgcataatcgcacaactctctggttattcagcatcgtccaatatgtgaataaagctctgaggaaaaattaatgcttgcttaatgctttgacacatttccctttacaaagcaaagatccctactcctctcactttctcacatggagaaaaaattaaaagaagcaggccacttacagacaagccacaatccatggcagcccctgcagaagcggctgcctctcagagaggatgagcgtggaccactggcccctaatcccaggctgacagatgcagcaaatgcgccacccaaagttcccagcacccaacacgcttgtgggcagcacagccacaagagggaagctcagaaccgtaaatcagaacatctaatgtttgctgcccactcagaacgtgctaagcaccattctaggatcttggcaaatattagaatggtcactcctgaagacaaccctccatccccacattcacagcagaggaaacagaggaacacagaagtaaattttccaagatcacacaactgggacatggcactaacagtctccagcacatctgatgtcacagagtcaataacatccggagatgaacaaaaactcagggcacgtctattcaacccccagatcacagatgaggaaactgaggttcaaagggaaatgtatgaatgaggccagagagtcagtaaaaaaaagcaggagcattactcataagacccataaatactttaaatattccacaaggatataagagctacaaatgttaaaacaatctgagaccgcatctttggactctacaatgagccagataaagatggtgcccttttctccactatcagtttactacataaatgagaagacataaagtagttttagatttaattaaagtaattgactggattgcattttgtagtcctgatcgtcattaacattcttgacctctctgtcacacagatgtgccggagaatttttccgatggatatttattatgaatattatcatcaataagcaccatcaacatattaaaattaattttaacttctttatggaagactgaaagcacaaccagcttttgaaaccatccgctctaaatcattttttatc

SEQ ID NO: 461116 - DNA, 1775 bp, Homo sapiens
ctgttgtgaaacgattcatactgcaagccgcctaaatgcagggcttttgatgatattccccgccaacaaggatgagtcaaggcctgccttgatgttgctctgtgtcctaccagcaattcttcctggaatcgtctgttcacatggatgtctaaatgtttaagcacccatgcatgaaggtggggcttgcctccatctggctctcctgccactttcaacaacacaccccacatccgatcctgcttagagtcgaagatgaatctggcataatacaaacagcactggactggaagcatgaagtttctcttatctgtgccttggtttcctcatgtggaaaatgaaaatgttgacataaataatcacacaggtctctgttagtaccattttgtgattttatatcgtgcttaccacacctagaaacaggggccatcattccagccagctaacagagaaaaagacgatacataatcaggcttgggaaaataaatttcagagaccaagtaaacaaagacaacaatctagtataagggttataactgggggatgaggggttgcaaatggagatctgccacagtcaactctatttggattcccctgttctcaacaggcaacagcaatcataatgggcttggagcaccagtcccacaacatcacaggacatccagacataattgcattaataatgttgtgcataatcgcacaactctctggttattcagcatcgtccaatatgtgaataaagctctgaggaaaaattaatgcttgcttaatgctttgacacatttccctttacaaagcaaagatccctactcctctcactttctcacatggagaaaaaattaaaagaagcaggccacttacagacaagccacaatccatggcagcccctgcagaagcggctgcctctcagagaggatgagcgtggaccactggcccctaatcccaggctgacagatgcagcaaatgcgccacccaaagttcccagcacccaacacgcttgtgggcagcacagccacaagagggaagctcagaaccgtaaatcagaacatctaatgtttgctgcccactcagaacgtgctaagcaccattctaggatcttggcaaatattagaatggtcactcctgaagacaaccctccatccccacattcacagcagaggaaacagaggaacacagaagtaaattttccaagatcacacaactgggacatggcactaacagtctccagcacatctgatgtcacagagtcaataacatccggagatgaacaaaaactcagggcacgtctattcaacccccagatcacagatgaggaaactgaggttcaaagggaaatgtatgaatgaggccagagagtcagtaaaaaaaagcaggagcattactcataagacccataaatactttaaatattccacaaggatataagagctacaaatgttaaaacaatctgagaccgcatctttggactctacaatgagccagataaagatggtgcccttttctccactatcagtttactacataaatgagaagacataaagtagttttagatttaattaaagtaattgactggattgcattttgtagtcctgatcgtcattaacattcttgacctctctgtcacacagatgtgccggagaatttttccgatggatatttattatgaatattatcatcaataagcaccatcaacatattaaaattaattttaacttctttatggaagactgaaagcacaaccagcttttgaaaccatccgctctaaatcattttttatc

SEQ ID NO: 461117 - DNA, 1742 bp, Homo sapiens
aaagtttcagaccaaggtgccagtagatccagtgtctgataaggatccactttctggttcatagacagtgccttcccactatgtcctcacatgttgtaagaggaagtattccagaagaaggcactgttatcataggagatgacagctccgtgcatgttattgcatctaaacaccttccagtggcacaagatgtggagttagaagacagtgatacagatgatcctgaccctgtctgttggagtttgctagaggtccacttcagaacctatttgcctgggtatcaccaggggaggctgcagaacagcaaatattgctgcttggtccttcctctggatgcttcgtcccagaggggcacccgcctgtatgaggtgtctgtcggcccctactgggaggtgtctcccagtcaggctacacgggtgaggcgacaccctgccctgcttcagctcaccctccatgggctgcacccactgtccaaccagtcccaatgagatgaaccagattttgtgatagcatattttgcatttatatcacaatgtatcaaaatagatggtttttctgttctttcatactctgagctcctagagagcagaaaccgtggtcatgtttatgaatccatagcacctttcatagagtgtgatatataataggcacttggtaaatgtttaaatgaaatcaaatttaaaaatatagtatttaaaataaatgtcactagttgtgcttaacagcagcatattggagatgaaggaagagtcagttcacttaaagataaatcaataaaaagtatccaatctaaagaacagaggaaagtggggaaagcctgtaataaaacagacagaagctcaggagtctaattatgtgtaattatcatccccaaagggaaagaggaagaacatgaagttggaaaaaatatttgaaaaaataatgacctaaactttccaattttggtgaaagacataaattataaatttatgtctttcaagcttagcaaacccaatcaggataaatatgaagaaaattttgtctagggtcattacagttaaagtgctgcaaactaaaaagaataagaaaatcttgaaaacagagaaaaataaattatagaattacataaagggacatcaatgtaaatgatgactcacttctcatcagaaataatgaaggccagaagacacggaaacggtattttttaaatgccaaaagaaaaaagctgtcaactctgaaatacaaatccagtgaagatattattaaagaacagtggagaaataaaaacatttccagaaaaaagaaaactaaggggattacttaccagcatacctaacactgtaagaaatgccaagaaaattctacagactgaaaagaaataaaaccagcttgaatttcagctcttcaagaaggaatgaagaacatgagaaatagtaaatatgtgggttgaagcatatgaagaaaatccatcctcacacatatatatagttggaaatggaggagaattttaatagacttttcagataattgtggatatcttctttaatactacaccaaaactcagaagtggaggtttcttaaaggttagttgccatgtggaatataaaaccatattggtgaactttttgtcctctccattggtcaatcttgcatttgaatcattttgtaacatcgcgcattaatcatttggaaaagaatggtcctagatcttcaaaatgttgatacatttcattagacaatattcaaaagcatgtgttaattat

SEQ ID NO: 461118 - DNA, 1122 bp, Homo sapiens
tccgagttgccctcccagaggagaaagcatatgctgctgggaccgactgcagctcctcatggatgcacctgccaccagaaaattgttgttcagtctgggattgctttctcttcccaaagcacaatctcacatgcagtcatgagcccagtccagcctctgggacagaagatttcgtgcttttataaaccaacagcactgcaggtgctgcacaaggaatggaaaatcaatctgagtgtcattaagagcatattccctgaagaagattgctgatgacagtggatttgtcacccagctcagtgtcttttcctgagcaataggaatttcttccatggggaatgaaacctagtgttgtttccctgtctgaatccaggcctttcactgacctgccaagttttcattccattgtctcactgtcattggctgatctgatctctacattgattaattagtttcaagccccttcatattgatctaataaaattggcttgtttaatttgtgtcaagaaatttctgagaatgtttcatttagactctgataagcttggacccaagctgggggccacaggggtctcctgccttcttattaggctgggagtggggcagcttctcaatgagaggctacagtggtttgccggggctgatgtaacaaagtaccacacactaggtggcttgaacagcagaaatctattgtctcagttctggagccacaacattctcttaacccaaagcctaatccagagcaagaccctaactctcttcaattctatgaagactgagagagaggaggaagctgtggaaaagttggaaactaacaaaggttggcttacgaggtttaaggaaagaagccatcttcataacatgaaagtgcaaggtgaagcagcaagtgctgatatagaagctgcagcaagttatccagacgatctagaaatttccacagccatcccatcctttagtaaccaccaccctgatgagtcagcagccatcaacatagaggcaagactctccaccagcaaaaagattatggttcactgaaggctcagatgatagttaacatgttttagcaataaggtatttttaaatttaaggtatgtacatttaagcatttatcggggacaatggaga

SEQ ID NO: 461119 - DNA, 1178 bp, Homo sapiens
  misc_feature (2)..(3): n is a, c, g, or t
  misc_feature (5)..(5): n is a, c, g, or t
  misc_feature (7)..(7): n is a, c, g, or t
  misc_feature (12)..(14): n is a, c, g, or t
tnngngnctttnnngcagttgcacacgcatggtacctggaggcaggctgcccccaaagacaagaatccagtgtgtcctcagtgacctgcagcagtgtgatggagaaaatgaaacatctggctgcctctgggggcgcacagaaaggccaggtgctctacaacccaagcaataatggcttggccatcacacttacgtttgagaagaatgaggccaaggcaaaccggacagatgccgaagcgtacaactgccggatcgtgtggggcaagaacctgagactctgggctgtggattcagcaagggctcgccgacctagaatgggtgctggcgatgtggatttttccaagtggtcctggtaccacaattttagcagcagatttctataccagggcctagcaaagggccaagtgcccaatgagaaatgcatacatatctacgaattgagtgatgagtttccactcttcttcagtgtcatgaacagatcaacttgcccacagcaaaagtgacatccatcgatgcaggaaccaaaagccccagcttcaggctcctctcactagctgtgagacaggaggaaaggttgggagatatttttttcccctttcctacaaccatgcattgatcttaaatgagttccaaatagatgagttctgccaagtcttcttgaagtacatttctgtaccttacactataacctgcttcgaaatgttaagtgttttaaaaacaactttccacataattaaatattccttaccattatttttatttattgactgctcagtatttcacattttaagcaatattctgtgggaaagcatttgcgttgctttctttttgcaaactgctaaacatagttgcacatatatcttagagcccaaatccacatattgtcttgaaataaatacctgaatagggcaacttctgtgtagaaaggcaagctcattaagatagattgcccgccatgaattttagagtcctaccagaagagcatgatggtaagtgcttttatcaaaggtttttgaagaggaatttagagagagagggagaaaaaaaataaatctttttaaggatgattattatgccaagtggaataaggatacagaaatgtgagaggggacaaagaaatctttgtgcatctaactgttgctgtgaggacttagctgtagaattcaattttctaaaat

SEQ ID NO: 461120 - DNA, 1118 bp, Homo sapiens
ggcctcccgcaggacgcgcccccttcgccggcctgggcctgccgtgggaaggaaaggccccgggccggcccggagccactgggaaaaagcggaagcccggcagagccgccgagggccctgccgaccggaccccgggcccctcctcaccctcgtagacctgccatgctggagaagcccatgtgacaaagacctgaggctgggccccagttgacatccggctacaactgaggctatcagtccaacagccttgaaggattgaatcctgccagcaactgtgtgagcttcaaagtggatccttcctcagtggaacattcagatgagacctcagccctggctgacatcctgatcacagccctgtgagagtcccagaagcagaggccccagttaagctgtgcccagacttctcccccaacagcccaacagctcttgagtgagtgagacagagctgacttgagtcctggggtcacagatgcttacagggtctgtgactttggcatgtcctgagagggctgcctacctctgaaccttggaaccaggccgcagatggaggcagaccctgggagtcaccaagcggctttatgatgtgcagatggtgtttccgcggagcccctcgcttttcatgtcggtggcctctgggagctgggccagcccagatgtccctgatcgtgagaaagcctcccctggcaaggctggtgcaggatgccagtgacggggcctctggccagttctggtgtgggttgtctgagtgctcagacaaggctcagaggatgtcgagagctgaaaagagtcctgctgaccatcctaggggcgggcaaatttcagcctggactcggaagacctgcccttgcccaaagcacctgaggagagtgggatcagtgtcagccacagcaggttccagagagacacaggtgaggaagactgttgtgagatgtatggaccctggacagagtttgttttgtgacctgctacataacccaacttctggctctgggcttggttcccaacaagagttcagtgatgacgagtgaataaatgaatgaacgaagacctggttcctgtccttgagaaactcaactcttctaaggaagaaatgaagcccacttctcttgggtgcctct

SEQ ID NO: 461121 - DNA, 2435 bp, Homo sapiens
tatatttgatagagactggcttgggttaagtgagtaggggacagacattctaagtgagactgtccacatcatctaggaaaatggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagtatttgacaggcagttgagaaattggatcccttccaaatcagatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagagtaaatgacattttgtttctcttttttctcttttctcctgtcttctttctctttcagctttttatttttgagctaggtgtctaagatcataccctaatttcaatcatttgtgagaatgctagcttttcttccatcgagtagatgaccaaatttgcagattttggggaaagcaagagaaattcagaagtttcttttgctgaatagaaattcagtgatctgtgtccccctccaccccctttttttccttctacttcgtcttagtgaagaggaaagtaaaaaaaaaaaccaaaaaaaaaaccgctccagtagggccaaggtgtgaacgccagtgtgggggttgtggggaggacatgagctttcctgtaggatgtgccagtcagcatgagatgtgtccagcaggccattcttggtattgtgcattcattgtattgtttcaagtgtattgcagggagaggataacggagaggcttctttggcccttgaccccagtttcactttggtggaaagtagttgggaccagagtatgcctttgagtaagaagaaaacttaacttttcttctggtggcagagaatgcctggccaatatgctgtttggtctatactgagttgttaaccccccaaaaagcaaacctctgcccttgggttagcgaatcccagggaacctttacaaggtgacgccgtgtcctgcagtgtgccacacattgtgagcctgaggctgaggacggctctgagcagtttctaccacctacttagttctgtattctccaaatgagtcatactgccgggtgttcctcagggcctgcttttaccccaccagtctggcttccttcctcaggaacctcgggaagcttccccttctcttccgccacctatcgaaggccatgtgcacaagttcctttagcagtttccacgttcccaccttctagcctcacggctggcccctcagatacaactgatgtcatcagcctgaggattatggccacggatattgaggaataaacaccaagagctagaggggccttggaggaaacaacattttgtttctgttgctagagtgactggtgacaaatagaaaatggagggaagattgatgaattttaaaaaatggaaataaaacgtttacctatttttaggcatttgtagctgtgaatctatgtctccctgtcatataatgaattcatatggaatagcattaggcagcagtattctcagtggctaggaaatgtgctttggaaaagaaagacttcagtttggatcccggctttgccacttagtagtttgatcttggataagttaccttacctttcatctctaagcttcagtttgttcacctataaaattgtgactttttatgaggtttaaataagttaatacagaaaaagggactgcctcatataaatctccataaatgggagctgtaaatgtctacattcttccttctttcattgccttcttttgcatttcatcatgatctgctacaccaaaaccccacaagcaacagtaaggcatttcccatgaccagcataaaatcttgttttattccagaaaatcacgtgtaacccttctcacttccaaatttgcctttgaaaactttttgcagacttacccagagccttgaggtgtt

SEQ ID NO: 461122 - DNA, 3655 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (843)..(843): n is a, c, g, or t
  misc_feature (1650)..(1650): n is a, c, g, or t
ntnntnttttggtaaattccctttaattaacaggaaaaataaacacagttctcttatatgtcttgttgtgttgcagtaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggtacagtatttactgctcagacactgaggttggtgagattgcaggaagctcctggctgtatcttgtggcgagcaggagggcggcgctggcttctgccacatttatggcgtcgtttccagcaggcgctgctcgtgggtccccgcatgtgtttggttgtggtgcaggttgatattctggatgagcagctgaccatccggagtagggcctccctatggcttcccagattgtgtcctggtagccaacactgtgtccctctctgccgggctttgagggacagttgtatttcacttaactggctcaccatttcaagtgcactaaaggtttcttagctggcatcttagaatgcaagagaatgttggtcagaaatcaggactctcattaactggaagatatcctctcaataacctttcatgtctttacccttaactaattgttaaaactgacaagtcatttaacatatctgagttgcggtttcccagtatgtaagatgtggattgcactagattgtccccaaggtttcttgtggctcaaggaaaacatcatccatctttgtcctctcctaccagcttcctttcttcctttccttccctccctccctttcctctcgttatttatccatctatntgcccatagaaataatgtaggggttggcaaactacagtcatgccttttgcctgtacttgtcaataaagttgtattggaacacagcttatgtattcaagtattacatattgataaatccccttgagggttatgtaattgttacacatatcttctgtggctgttctcgcattctggtgacagaactcagtgacagagactgtgtggcccaggaggtttgaaatgtttactatttggcctttagagaagtttcctgacccctgagttagtggacggaaggatggcatggaaagagggctgagaggaaagaagtggggaggccaaaaggagagagatagcagggcagtgaaaagatgcttgttggcttaaggcttagagtgatagcttggagtgtccatcttagggtgatctgggggtcatttagagaaaggaaaggctgaaaaggtgggggggggaagcaacagcagtgatggatggagaaactgggaggaggaggagttcagacacaacaagctccccattttaggatgcattcgcttgtcatttcccctgctgtcttgagtattgagttcttgtctgtgtgtgtgtgtgcctatcgcctttctttctcttcctctattacattggtttttatctggggatgggggttgggttgattttacctctagatatttgattagctagctttgtgatttaggattgtaaaaagtacactgtatttgtcttttggcctctttgaagctgatcatttcatatgagtttcctttgcctctttttataatcacttctgcctttctggactgtcatcanactttgcttttgctgtactggacacctctaatgttttccatctacaggccattttggacaaaagtttgtttttcttttgccttagttttctcccatgcggtgatcatccactgtgtcctgcacatgtcaccgtgggttggctggcactgtcccctgctccacagagggtgtactgggccatgggaatgcgtcagtggagagaacgtgtcactccccgaagcctctgatgcttttccttcctcttgtgtttcaggcacgggatgacatcctgaatggctctcaccctgtctccttcgagaaagcttgtgagtttggtggatttcaagcccagatacaatttggacctcatgtggaacataaacacaaacctggatttttagagtaaatgacattttgtttctcttttttctcttttctcctgtcttctttctctttcagctttttatttttgagctaggtgtctaagatcataccctaatttcaatcatttgtgagaatgctagcttttcttccatcgagtagatgaccaaatttgcagattttggggaaagcaagagaaattcagaagtttcttttgctgaatagaaattcagtgatctgtgtccccctccaccccctttttttccttctacttcgtcttagtgaagaggaaagtaaaaaaaaaaaccaaaaaaaaaaccgctccagtagggccaaggtgtgaacgccagtgtgggggttgtggggaggacatgagctttcctgtaggatgtgccagtcagcatgagatgtgtccagcaggccattcttggtattgtgcattcattgtattgtttcaagtgtattgcagggagaggataacggagaggcttctttggcccttgaccccagtttcactttggtggaaagtagttgggaccagagtatgcctttgagtaagaagaaaacttaacttttcttctggtggcagagaatgcctggccaatatgctgtttggtctatactgagttgttaaccccccaaaaagcaaacctctgcccttgggttagcgaatcccagggaacctttacaaggtgacgccgtgtcctgcagtgtgccacacattgtgagcctgaggctgaggacggctctgagcagtttctaccacctacttagttctgtattctccaaatgagtcatactgccgggtgttcctcagggcctgcttttaccccaccagtctggcttccttcctcaggaacctcgggaagcttccccttctcttccgccacctatcgaaggccatgtgcacaagttcctttagcagtttccacgttcccaccttctagcctcacggctggcccctcagatacaactgatgtcatcagcctgaggattatggccacggatattgaggaataaacaccaagagctagaggggccttggaggaaacaacattttgtttctgttgctagagtgactggtgacaaatagaaaatggagggaagattgatgaattttaaaaaatggaaataaaacgtttacctatttttaggcatttgtagctgtgaatctatgtctccctgtcatataatgaattcatatggaatagcattaggcagcagtattctcagtggctaggaaatgtgctttggaaaagaaagacttcagtttggatcccggctttgccacttagtagtttgatcttggataagttaccttacctttcatctctaagcttcagtttgttcacctataaaattgtgactttttatgaggtttaaataagttaatacagaaaaagggactgcctcatataaatctccataaatgggagctgtaaatgtctacattcttccttctttcattgccttcttttgcatttcatcatgatctgctacaccaaaaccccacaagcaacagtaaggcatttcccatgaccagcataaaatcttgttttattccagaaaatcacgtgtaacccttctcacttccaaatttgcctttgaaaactttttgcagacttacccagagccttgaggtgtt

SEQ ID NO: 461123 - DNA, 1263 bp, Homo sapiens
ccagaagcattccagcctgaaggaaacctcccagagctcctcccttctaggagacacaggaagggaagttctattttctttgccttcttggaaacccaggagtctgcccaggttctcacctgatgtcattccaagagagtctcagagtgactctggcacctagcatgagtcaaccccagggctcgatttctcttaaggctggagattagcagaggcctgcctggtctaaacccctcactgatacaaagactggggccatctggagggctctagggatggctctcaactcagctctgacggaagtcgattgtcccccttgcccagtaccttcatgccccagccctttctccccaggctactacagtgccctggctgcccccagcacggaaccccaccaccctgtccctactgtggagcctgccttccttgggcagcaccccaaattccagacctttcatggcttcttcagcacctcccagtttgggacactgtggcaagttagtgttctggcttggcctcagggtcccgtggagacaggtccagcggtgcttcagccctgggctcaagctgtggcagggagagaggcagtccagcggcagcaaggatgggaagagcagctggacactcagagcatcgtcaccacagcagaaggcaaactccagccctgccgctcccctctcctccactttgctaaaacaagccagagaagaactgcaggccttcccagaggaccctcacctgccagcctctctagcaagtctgaatggaggcccctccctgtctacttagccctctccagtggtccggcactacattcctcgctctataatttcttctaccttgatctttaagcgttttcttgcctgtgtaatcatttcacctttcatgcctgttagtgctgtttctgaaagaaaagggactgtgtcatagtcatagctgcaccccgggtaatatccacagacacatagtagatctcaggaaatgcttgttctgagagtggctgggcagggtaagttagaacccaccccggtgctccctgctctttccccacgctgctaccaaagcaccagccctcccaccatcaccttctctgtttccctgcctctctgcactgagagtcctggagtcagcactcctgtccactcacattggaatcctccttgcctagcatggtggctggcacataactgttattggtattcactcatttcacatttattccacgccttccatcatgtatgtcttagaatgctttctacacaa

SEQ ID NO: 461124 - DNA, 1081 bp, Homo sapiens
taaatgacatcttgagtctccaaatctgtgctatggagacttctttattttgaggtgctcattctggttgagtatatttagtgtttaagaaagcaattcaaaagttaaaaactatgtttgtttgttttttttcattgagtccctctgtctggacaaggaagactccttctaataccctttctggtgctgcagactttcaatttctacttacagtgtttgtggatggcaatggaaaatgtatttcctgctgagcctgaactggaaataaaattttggagaactttgggaaaaactggcaaagattccaccaaggtgcacatccaagggggctcaaatagttgcagatatccccttggtatggggaaccacggatatagaaaatacatgtcatgtcttttggtgcttgttgtggagagtcaatgcccacaaccaatgtgtcttaggttgggaaaggaagaagttgcagctgatcaagcccccgggtggtgggaaggtgatagtgcttggagtgggggtgtcagggacacagatgctcaggaggaggcctgggctaagctcttgaaagctctggcagtaaacacagctgctggactcacctctagcacacattctaagacaatgtcaatggctcccatgtccttttatggaaatctgagagtcaatggccttagtcaaacatatgcagatatttttcttgaagggtgtggctgcagccacacagacctaactgtacaagaagcaaggcttcagtatctgcatctggtgagggctttagtccgcttccactcatggtggaaggtgaaggggaggtggcctgcagagatcacagggcaggaggtcctagacagtgcaatacacaaaagaaatatgagctataattattggaatgaagaaactgtcatgattacagatcaattatcccaaaagtaatctaaaactttaattaaaactccaacagatttttttcttcacagagctagtcagttcatgtggaactagttaattcatctggaagaatcaagaaccccaaatagctcaaaatagtgattttgaagagggagagtaaagaaaaagcacatgc

SEQ ID NO: 461125 - DNA, 733 bp, Homo sapiens
cgttaagccagcccaggggacggcagagcagcctgagggagcaagaactgtcaccacggtctgcccgcgaagcactgaggtgatgctggggttgcagtgagctgtcaaactagatgtgtcagaaatgagaaaggagatgagagaacaaattagaatacagagtgatcgacactttgatgaaggaagtaagtggagcctggggtccatgaaacccactgccaaaccaacccagacagactcagtgtgacattacaagcatcctgggtggaactgcaagacatagttatttcaagattatgaagagtgtggtagccaaactccaagatggccgcatgatccctcctccaggtactcgtgcccttgtatggtatgctcccacagtcttccgaggattccgttgtatgactgatcgaatacagcagaggcgatggcataggacatctgaggctacatcatctaagggatacacaggaattcactcccatcctcccatgtggcttctactttgctcttaatctctcagatctctcaccctggcagacaccatccaccatgtcctgaggacactcaagcagctctgtggcctcctgacaatagctgttaggtgaaacaccttgggtgcagaccctctagccccactccagccttcagaagacagcagccccagctcacatgggaccctgagccagaccaccaagcaaaccactcccagattcctgacccacagaaactg

SEQ ID NO: 461126 - DNA, 1858 bp, Homo sapiens
cgttaagccagcccaggggacggcagagcagcctgagggagcaagaactgtcaccacggtctgcccgcgaagcactgaggtgatgctggggttgcagtgagctgtcaaactagatgtgtcagaaatgagaaaggagatgagagaacaaattagaatacagagtgatcgacactttgatgaaggaagtaagtggagcctggggtccatgaaacccactgccaaaccaacccagacagagacaaagtatccctatgtttcccaggctgatctcaaactcctggcctgaactgacctcctgcctcaaccgacctcctgcctcaacctccaaagcactgggattaacagcataagccactgtgcccagcctaatttttacttttcaactttgtacgttgcggtgtttttaatacccctgccaagaccacagttttaggtaaaccgccatcctgcctatacccatgtccctgttccctttcctagctgtgtgaccttgggaagttcccttgcctcacgaggcatcaacttgctcttctgttaaacggggacaacagaaccccgtgagacactctgacaatcacatgaagctatgtgaataaaacatgggcctagtacatagcgagtgtacagcagctgctcactagtctttcaacaagtagcgactgagagtctattacatgcaggcacaggcataggtgctggggatacaagaatgagcaaaacactggtaatgggacagactgatggtaacgggacagactgctggcatattggaaattcagaaaactccctgccctcccagtggcaggaggtacagcaagccggcaagtaagtaaaatacactggatgtcagagggtggtgctcagtgttgtgtgagcatcaaagcaaagaaaagaagaagggtgctaagcagggcttagacatttaaataaagccatcaaggaaaacgttgcagagaagataatatttgaataaaaactcaaagagggtaagagtacaaattatgctgatgtcggttttgtcttccaccccgcccccaccgtctctgcacagtcctctgctccccacccccacctaccctctccgcagctcctagaacagtgctctgcacaaagtaggtggccgataaaaaatattatgagattaacaagtcttagggaaaagcatttgtggtcaggggaacagcatgtgtaaaggacacaaggcatgaggaccatgaaaaacagtcaagctgaaagtgagggtaacaacaaccacacttgcccccggggtgttatgacaattcacaagaagccagagcagaaaggacaagcaaacctgcctcaaactggcgtcaaacctgagtcaatgctcagcggaaatgaaggccggcttggtgagaacctaagcagagaacccagttcagctgtgtccagacctatgaccaatcgaagcaataagatgactcagtgtgacattacaagcatcctgggtggaactgcaagacatagttatttcaagattatgaagagtgtggtagccaaactccaagatggccgcatgatccctcctccagaagtcactaagttcagtgtaactgtcacgggcaagagacagccaatacaatactttcgtgcttcatacatcatttttccatctatccaaaatgggaagaatacttcacagacttgatgtgaagctgcaagactcctggtactccactgatgcaggtgggtcagaggatgagggatacacgggaattcactgccatcatcccaggttatgtaccccagtgactccaagcccaatgccatgatgcaggaccccagagcactcagtaagcattcctgtccttactaggaagacaacccaatgacattc

SEQ ID NO: 461127 - DNA, 7580 bp, Homo sapiens
tggcccggcaggcttctgcattggttgctccgagtgctagagagccaggaggagagcgggatggaggaggtggagaggcaggggccaggtaggcagaggccgagtctgccttgtgtagctatagtgccttacagaccaagaaaaatgggtctgatggtgagtgaaaatgaatcaaatggaggagaaaataaatacagcgagaaaacaatcacaggaatgaaggtggttgtagcagaagggtacaaggtacaaggtagaatgggaggaggcccactgagtgatggtttgagcagggctggatctggaagtccttcggtgccatgttgcagaatggcattctgcagagaaatgtactatgatgggttccatcgttccttttgtgatacagacgacctggaaacagtccatgaaagcgactgcatttttgcctttgagactcccgaaatatttaggcctgaaggaattctcagtcaaagagggctcctcttcttttgctctaccccagtggttattaatgcatcagtattacctgggaactggttagaaatgcaaattcttggtccctactccacaccgagtaaaggagaaactctggtaaacaagccctttagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtacagtctgtcacagcttcccttggctaggaaagggaaatcccccgaccccttgagcttcccgggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcgaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctgga

SEQ ID NO: 461128 - DNA, 1958 bp, Homo sapiens
tggcccggcaggcttctgcattggttgctccgagtgctagagagccaggaggagagcgggatggaggaggtggagaggcaggggccaggtaggcagaggccgagtctgccttgtgtagctatagtgccttacagaccaagaaaaatgggtctgatggtgagtgaaaatgaatcaaatggaggagaaaataaatacagcgagaaaacaatcacaggaatgaaggtggttgtagcagaagggtacaaggtacaaggtagaatgggaggaggcccactgagtgatggtttgagcagggctggatctggaagtccttcggtgccatgttgcagaatggcattctgcagagaaatgtactatgatgggttccatcgttccttttgtgatacagacgacctggaaacagtccatgaaagcgactgcatttttgcctttgagactcccgaaatatttaggcctgaaggaattctcagtcaaagagggctcctcttcttttgctctaccccagtggttattaatgcatcagtattacctgggaactggttagaaatgcaaattcttggtccctactccacaccgagtaaaggagaaactctggtaaacaagccctttagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtacagtctgtcacagcttcccttggctaggaaagggaaatcccccgaccccttgagcttcccgggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacaggtctgcagtgtgagaggctgcgtgtctgtgctggcgagtccttcagacgggtttgcttgtggcagggtgacttgactttagagcctcatttcccctccggtaggcagtgtgccaactgtgagggcagtttccatcctctggatctctgcccaagagcaaataaacgaacattcttcctccttttcctgag

SEQ ID NO: 461129 - DNA, 512 bp, Homo sapiens
aatatggtattaaacagcatggaatcgggcggggcgcagtggctcatgcctgtaatcctagcactttgggaggccaaggcgggtggatcacctgaggtccgggggttcgagaccagcctgaccaacatggagaaaccccatctctactaaaaatacaaaattagaccggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctgga

SEQ ID NO: 461130 - DNA, 1259 bp, Homo sapiens
tggcccggcaggcttctgcattggttgctccgagtgctagagagccaggaggagagcgggatggaggaggtggagaggcaggggccaggtaggcagaggccgagtctgccttgtgtagctatagtgccttacagaccaagaaaaatgggtctgatggtgagtgaaaatgaatcaaatggaggagaaaataaatacagcgagaaaacaatcacaggaatgaaggtggttgtagcagaagggtacaaggtacaaggtagaatgggaggaggcccactgagtgatggtttgagcagggctggatctggaagtccttcggtgccatgttgcagaatggcattctgcagagaaatgtactatgatgggttccatcgttccttttgtgatacagacgacctggaaacagtccatgaaagcgactgcatttttgcctttgagactcccgaaatatttaggcctgaaggaattctcagtcaaagagggctcctcttcttttgctctaccccagtggttattaatgcatcagtattacctgggaactggttagaaatgcaaattcttggtccctactccacaccgagtaaaggagaaactctggtaaacaagccctttagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtacagtctgtcacagcttcccttggctaggaaagggaaatcccccgaccccttgagcttcccgggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaaggcataaatctacgtggcaattaccgtggcaattacgtggcaatct

SEQ ID NO: 461131 - DNA, 8133 bp, Homo sapiens
tggcccggcaggcttctgcattggttgctccgagtgctagagagccaggaggagagcgggatggaggaggtggagaggcaggggccaggtaggcagaggccgagtctgccttgtgtagctatagtgccttacagaccaagaaaaatgggtctgatggtgagtgaaaatgaatcaaatggaggagaaaataaatacagcgagaaaacaatcacaggaatgaaggtggttgtagcagaagggtacaaggtacaaggtagaatgggaggaggcccactgagtgatggtttgagcagggctggatctggaagtccttcggtgccatgttgcagaatggcattctgcagagaaatgtactatgatgggttccatcgttccttttgtgatacagacgacctggaaacagtccatgaaagcgactgcatttttgcctttgagactcccgaaatatttaggcctgaaggaattctcagtcaaagagggctcctcttcttttgctctaccccagtggttattaatgcatcagtattacctgggaactggttagaaatgcaaattcttggtccctactccacaccgagtaaaggagaaactctggtaaacaagccctttagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtacagtctgtcacagcttcccttggctaggaaagggaaatcccccgaccccttgagcttcccgggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcgaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaat

SEQ ID NO: 461132 - DNA, 7526 bp, Homo sapiens
tggcccggcaggcttctgcattggttgctccgagtgctagagagccaggaggagagcgggatggaggaggtggagaggcaggggccaggtaggcagaggccgagtctgccttgtgtagctatagtgccttacagaccaagaaaaatgggtctgatggtgagtgaaaatgaatcaaatggaggagaaaataaatacagcgagaaaacaatcacaggaatgaaggtggttgtagcagaagggtacaaggtacaaggtagaatgggaggaggcccactgagtgatggtttgagcagggctggatctggaagtccttcggtgccatgttgcagaatggcattctgcagagaaatgtactatgatgggttccatcgttccttttgtgatacagacgacctggaaacagtccatgaaagcgactgcatttttgcctttgagactcccgaaatatttaggcctgaaggaattctcagtcaaagagggctcctcttcttttgctctaccccagtggttattaatgcatcagtattacctgggaactggttagaaatgcaaattcttggtccctactccacaccgagtaaaggagaaactctggtaaacaagccctttagagctcaaatgccatgctgggagaaccactgctctcttcaaagctgtcagacaaggacctttaagtctgcagaagctgtctgctgccttttgttcagctatgccctgcccacagaggtggagtctatagaggcagcaggccttgctgagctgtacagtctgtcacagcttcccttggctaggaaagggaaatcccccgaccccttgagcttcccgggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcgaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctgga

SEQ ID NO: 461133 - DNA, 1778 bp, Homo sapiens
ggaggctgagaagtcccaagatctacatttggcaagttggagacccaggagagtcgatgttgtgttccagtctgaaagcctgaagtcttgagacccagccaataattcagttcaagtctgaaggcaggaagagacaaattccaacacaagcaatcaggcaggaggagttccctcttacttgagggagggtcagcctttttgttctattctggccttaagctgattggatgatgcccacccaccttgaggagggccgtctgctttattcagtctactgattccaatgttaatcttgtccagaaacaccctcaaagacacacatattattaccagaataatgcttgaccaaatatctgggcaccctatgacccagtgaagttgacacataaaattaatcactgcaatatctttctgacatctatccatttttctgagtactcaaacacataacctaccatttgcattttgctttttcttggaggcctcctacccttagtcttccaccctcctactccagtctggactagttgtgttctaggctgggagcatagctagcatcctctattgtggtggcccctgtctaccacatcctgctttcttggttactgaaagcacatcctctaatagcttctcaagaaagggtgcgagggaagtattgttttagcttctgcatatctaaaatgtgttgattgcaccctagacttgacataattaaaccagttttggaaatcagtgttggaaatcatttgtttcttagagttctgaaggtattccaccattgtcttccagcattctgcttgtggtaagaccaatgccatcctgatgctctttgttttgtgtgtgattgaattttgcctctggatgcttttcaggtcttcggttgatttctggcattccgctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgggcattctttcataatcagaaaaagaaatgtagaagcaccaaattgtatcatgagcattcacaaagatttcttgtgcctacttccacggatgtacaaggtctactcaacaaatgtggcctttgcctgccagcatctttggggccgtgggaaggattttgaaaatggtgtactctccatgtctgtgtctcaggtccagatcgtgagatctgccaaggtgggagatgccctttagatatgatgacagaaaagtgagccaagaattctgagtatgtatgacacgatgtttcaagcttgtattttaccagtcctagccctggaatcagccatttttccaaggagccctcgtccattttttttggagaatagtatttacaagccaaaatctggacaataaatgtacctgttgctcttgtggtgttgctgctcctagacccttgcagtcaaacagagctgggcaatgcgtcttatgtatttgtaactctcttctctggccatgagaaatctaggttccattatcttttatatttttactgtgtactccgtcaccctgaatgtaatcaatttcacatcaccactgtccccctgccc

SEQ ID NO: 461134 - DNA, 1015 bp, Homo sapiens
ctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgcttggtaatatgtgtgcagattattttctaaacatcgtgaaagctgatgaaaatttaccgagaactgctgtgaaagatccctttgtactctgggctccaatctctgtttcctcacccacgagagactgtcaaaagcacttctcaggcacttcttccagaattgccgaatgcagggctctcttgatctctgtatttcaccagtgtctggcctggaaggaccccactacactaccaacaatttctgctgttcatctttttcccatccttccccacggagacatccagccttttaccagggtaactgtgcactggggaaagggaaatgatcagacattttggggattactggataccggatctgagctgatgttgattccaggggactcaaaacatcattgtggtcctccagttaaagtagggacttatggagaggtccctactccaccattttcaatgatgtcttctccataattattaagagcttggttgtgtagtagtacttcactagaaaaaaagtctggctgttctgttttacaagatataggtatattgaagcat

SEQ ID NO: 461135 - DNA, 1148 bp, Homo sapiens
agcttagcaaacaataaaaggtttggcttgtgagccaacaccatttgattgttgaaagaaagaaaaaaggaaggaagaaaggaggaagaggcaggcacaagacaaaatgaatctctccgctgtgcacatggagccttagctctgattccagttgagcaaaattatgaagaagatgattccccatatggatgacagataaacaccctgtggcgagtcactcactcccgaaaggccctctgaaggatcgcgcatgtcctgactgcacagcctgctcctccacggtcctttcaaagtcactgcctttggatgtaagtttctcagagagaatgagccttgtgtccaatgcctggaaagcaacagcatttggccaccaagttcctcttcatcctcatcaagcagcttttcctgttttgtttttagctccaaccttaggacaatggacaagtcaatcagtccagattaccctgcaccagggaagagaggcacctgacagctatacccttcaccaagtccacggggacaaaggcacaagagtaatagaagctgcagggagaatgcaattctcatcaacccttggggttgccgcattgtttttgctctgttttccagaaagtctttaacggaggagaaagggtgtggaggaagggagggccttgcctattagcagatatttcaatgcagtcatcaccctcccgccattcaatgtcagggatcagcccttgcaaaggagcagtcattggacaatgggcacaatcagggctctgggtttttctgtcctgctgcacattcgacccgccttcctctgctgaaaaggctgcttttccactaggcatgccctatgtatggaaaaaacttctacctctggtttgctttcgtttgtacccacccactgcaaactaaaattgcatgaagcagaggctaagatggttttcctagtacaacgaatatctgccaactctaaatagaaagacttagatcaatgatgactagttaattaagcaaacttgagaaaggggactattcatttattccttacctttcactgagcagtttagaggctttcattggaaatatcattaatcacctgaaatgccttgcaataataactggtatccccattttacagtttatcatgtactaggctctgc

SEQ ID NO: 461136 - DNA, 1108 bp, Homo sapiens
  misc_feature (24)..(24): n is a, c, g, or t
caggctggtactggcggggagtanggatggaaggaagaaaggaggaagaggcaggcacaagacaaaatgaatctctccgctgtgcacatggagccttagctctgattccagttgagcaaaattatgaagaagatgattccccatatggatgacagataaacaccctgtggcgagtcactcactcccgaaaggccctctgaaggatcgcgcatgtcctgactgcacagcctgctcctccacggtcctttcaaagtcactgcctttggatgtaagtttctcagagagaatgagccttgtgtccaatgcctggaaagcaacagcatttggccaccaagttcctcttcatcctcatcaagcagcttttcctgttttgtttttagctccaaccttaggacaatggacaagtcaatcagtccagattaccctgcaccagggaagagaggcacctgacagctatacccttcaccaagtccacggggacaaaggcacaagagtaatagaagctgcagggagaatgcaattctcatcaacccttggggttgccgcattgtttttgctctgttttccagaaagtctttaacggaggagaaagggtgtggaggaagggagggccttgcctattagcagatatttcaatgcagtcatcaccctcccgccattcaatgtcagggatcagcccttgcaaaggagcagtcattggacaatgggcacaatcagggctctgggtttttctgtcctgctgcacattcgacccgccttcctctgctgaaaaggctgcttttccactaggcatgccctatgtatggaaaaaacttctacctctggtttgctttcgtttgtacccacccactgcaaactaaaattgcatgaagcagaggctaagatggttttcctagtacaacgaatatctgccaactctaaatagaaagacttagatcaatgatgactagttaattaagcaaacttgagaaaggggactattcatttattccttacctttcactgagcagtttagaggctttcattggaaatatcattaatcacctgaaatgccttgcaataataactggtatccccattttacagtttatcatgtactaggctctgc

SEQ ID NO: 461137 - DNA, 861 bp, Homo sapiens
ctcctctcttgtctatctctctttaggagcaggacccgtggtaccattggccctggcaagtatggctatggctgcggaggcccccatctaccagctacctttgacccatgatcaaggctaccctgcagcttcaagtctctttcacagcccagaaacaagcaacaaccacggtgtggggacccatggggcaactcagagcttctctcagcctgcccgatctacagcaatctcatgcatcggggcctatcggcagtacaagctgtgcaacaccaacgtatgtccagaaagcagtagaagtatccgggaggtacagtgtgcatcctacaacaacaagccattcatgggccggttttatgagtgggaaccatttgcagaaggtaagaatagacccagccctgtccatagaagttactttagtctgttttccattcttgttgacttctgattgatgttggaggtattggtgtgatcctggctggggtgtcaataggggagaaagtgtgactccagggcaaagagaagcctgcatgggtctttaccaaaggtagcatagctcaggtgacgcctggaccatcttcggcatgagtcagatggatgaggcactgatggaaacaagcaacatccaaggatggcagggtgagggggacagaacagggttcaaggaatcagttggagaagaggttcaaacataaagttgtgagccccctatgcaaaccacaaagaaaactttgctaatgttttcatgtattacatgtgaatgcctgctgttgtctggcttatgtatgggtctactttttctgttatttttttcccctctgatttgtgctagactttaagacctggaagaacttattttttgaa

SEQ ID NO: 461138 - DNA, 1065 bp, Homo sapiens
  misc_feature (5)..(5): n is a, c, g, or t
  misc_feature (7)..(7): n is a, c, g, or t
  misc_feature (12)..(13): n is a, c, g, or t
tcccnantttgnngatagagagtggggtgtaggcaggcgttaagcaatttgtccaaggacacaacagcagaagactgaattccctgagcgccaaggtgcgaaaggacaaagtcatggcagccaggaacatcagggaaatgtctccaaggagaggtattgggccacatttaagctacggcctgaagactgagaagggccaagctgtgaccagtggggagaagagaagagaggagaccatggtgagcagaggtggcagtgtgttcagaagcccgggggaggaaggagagggctctgcacatcctgagaacagcaaggtggccagcgtgcctggggtgactaactccggctttgagagtaaatgcgaagtatatcaggtcaaattaagtctcagagtgaaaagtgagtttgtgttcgtgaatgccctggtgacaagagtctctttttccccgaagaaagagattcacgtatggctgaaatttcccggagaacacaggagggggggaaatattgcaataaatcaaatgtcttttggaaatgaaggtggctctgaaggaagatcaaaacaaaagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaatagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgattt

SEQ ID NO: 461139 - DNA, 1042 bp, Homo sapiens
  misc_feature (4)..(4): n is a, c, g, or t
  misc_feature (19)..(19): n is a, c, g, or t
  misc_feature (37)..(37): n is a, c, g, or t
  misc_feature (50)..(50): n is a, c, g, or t
  misc_feature (65)..(65): n is a, c, g, or t
tcanaagctgtttcccccngaattcaggggccagaanagttcagtccatngaaccccaagagganggaagttccacacagttacccccagaagaactgaaacccaggaagggaacatcttacaggagcagagatttacactgtttttcccagggctgccctgggtcttaaggcacaattccttctcccagaaaacccatctttgccctgaagaacttcaatggattcactgaagcccacccatatttttcaagagtgaaaagtgagtttgtgttcgtgaatgccctggtgacaagagtctctttttccccgaagaaagagattcacgtatggctgaaatttcccggagaacacaggagggggggaaatattgcaataaatcaaatgtcttttggaaatgaaggtggctctgaaggaagatcaaaacaaaagccactagaggcctcctgcatgccttggctcgtggccccttcttccatcttcaaagccagcattgcctgctgcaagtccagcttaaaggaaggaaagttctaataaattgaaaatgttaactctgtggactagacatcttcacgtgcttcgtgttcaacatgttataacttcaccataatacaaattaccatcatgagtttatttttgtatatggtgtaaggaagaggtccagttacagtcttctgcatatggctagtcagttatcccagtaccatttattgaatagggaatcctttccccattgcttatttttgtcaactttgtcgaagatcagatggttattggtgtgtggcattatttctgggccctctgttctgttccattggtctttgtgtctgtttttgtatcagtagtgccatgctgttttggttactgtagccttgtagtatagtttgaagttgggtaacttgatggttagaatgttctatttgcttaggattgccttgactattcaggctcttttttggttctatatgaatttaaaaatagtgttttttaattcctatggtgggaagaaagtgtggataaaaaactgcctatcagatgctatg

SEQ ID NO: 461140 - DNA, 927 bp, Homo sapiens
  misc_feature (4)..(4): n is a, c, g, or t
  misc_feature (19)..(19): n is a, c, g, or t
  misc_feature (37)..(37): n is a, c, g, or t
  misc_feature (50)..(50): n is a, c, g, or t
  misc_feature (65)..(65): n is a, c, g, or t
tcanaagctgtttcccccngaattcaggggccagaanagttcagtccatngaaccccaagagganggaagttccacacagttacccccagaagaactgaaacccaggaagggaacatcttacaggagcagagatttacactgtttttcccagggctgccctgggtcttaaggcacaattccttctcccagaaaacccatctttgccctgaagaacttcaatggattcactgaagcccacccatatttttcaagagtgaaaagtgagtttgtgttcgtgaatgccctggtgacaagagtctctttttccccgaagaaagagattcacgtatggctgaaatttcccggagaacacaggagggggggaaatattgcaataaatcaaatgtcttttggaaatgaaggtggctctgaaggaagatcaaaacaaaagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaatagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgattt

SEQ ID NO: 461141 - DNA, 1567 bp, Homo sapiens
aagctctaccgcctgtgtggtgctgggtgtgagtcggagctagcctgggtttacctgagttgcagggtcacccctcatcgcacccttgtcagtcctcaaataggggtgcaactgttccatgaaagggaacaaagagactgagctactagacaccaagctgtttaggactgaacccattcctgtccaaacggaagtgatccagagggactctgaatattacagaagtcaagagatttcatcatctttattcaaagaaaggggtttgtttgttgattttttggattttttttttggaccacagctctatctactccctgaagagtaaggattattaagtaaatcagatggaaaaagaatcgcaaataagcataatgtgaagagcatgagctttggaataagcaagcctggaattacaattttcttttattagctctgtggctgtaatactcaacttttgcaagcttcagtttcctcgtctgtgaaatggaataatagcacttacctcattggctgttgtatggattaaatgagaccatgactatggatgtatggcatttggtacccaataacccctcaataatcggcagctataattattcataataataatggtggtagcaacaaacccagcccaaacatctgaaggaccgatcactaaaaagaagatgaactcagtcctacgtagtaacaagaatgtgacatctatgttgttgccaaaagtctggaggagttgccaggaccagagagaaggaggtggtgaggccggcctggaagagggaggggacagatgtcaaggaccccaatcttgaggtggaaagttctgtgattaacccagatgaatgtctctaacctccaactcttctgttctcagagttttaatggggcacaccgtgtgctgggcattgacatagatgggaaaagcatgacctaaaataagggctggaagccaagactgggaggaagggcaaagggagcaggcagcctggcaccaggaccctgtggcacacggggtgccctgcaagtcagcctgaggaaaaacacacaccgccccagctctgatttccggaggggccgggggcgacgcgaagcaggcaccagctcctaccacagcagcttaatgcgagtgccccgtgtgctgctggaccccaagggacagggttggcaggcagcacttcagtgcttcattagacagaccatgcacagcacttggtccagcccagtggcccaccaggggcatatgggtgtccagggcccgagcgacgggtgcagacaagttgcaagggtgggttttcttctcttactttctgacccaagccagaaagaagcgatttcactgcagctggttccaaattggagctctcaaaatatttattctgttgctgcagcagttgagctgcacagacctgtccctggaacattcagcagacagatccggcccgtggagaattcagggcattctgggctccacacacattttagaacaaaaggaaaggagcatggtattagggaagcgggagcctaggagagccagagtgccgccattttaaaatcagcttcatcttaaaac

SEQ ID NO: 461142 - DNA, 370 bp, Homo sapiens
ggtaccccgtactgactacgcggctcgatctgattacgcggctctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgccaaacctctaaaattgtaaacatgactcttagctggagggccacctgtggggcaggagtgtgccatgatttggcccatactttgtttggatttactt

SEQ ID NO: 461143 - DNA, 235 bp, Homo sapiens
ggatttgctggtgcagtacaactaggcttaatagggacatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 461144 - DNA, 4966 bp, Homo sapiens
gacaggcgcgatgtgggatgtggagggcacatcagaagtaaaggactgtgtgagccagtttgttgcagagatgatggtggccacgctggctcctgaggcacgtccttgtctgtgtgtctcttccagggacgaggatctgattaacaagtgtggggacgacgcgcgcatctacatcgtgttccagtaccacctcatcatctttgtgctcatcatctgtatcccctccctgggcatcattttgcccatcaactatactggatctgttctggactggagcagtcactttgctcggaccaccattgtcaatgtctccacagagagcaagctcctgtggctgcatagcctgctgtccttcttctacttcatcaccaacttcatgttcatggctcatcactgcctggggtttgcgcccaggaatagccaaaaggtcacaaggacactaatgatcacctatgtgcccaaggacattgaagacccagaactcatcattaagcattttcacgaggcctatccaggcagtgtcgtgacaagagtccacttctgctacgacgtcaggaacctgatcgacttggacgatcagaggcgccatgccatgcggggccggcttttctatacagccaaggccaagaagactgggaaggtgatgatcaggatccacccctgtgcccgcctgtgcttctgcaagtgctggacctgcttcaaggaggtggatgcagagcagtattacagcgagctagaggagcagctaacggacgagttcaacgccgagctcaaccgcgtgccgctcaagcggctggacctgatctttgtcaccttccaggactccaggatggccaagcgtgtccgtaaggattacaagtatgtccagtgtggtgtgcaaccccagcagtcctcagtgaccaccatcgtcaaatcatattactggagggtcactatggccccacaccccaaagacattatttggaaacacctgtctgtccgccgcttcttttggtgggcccgctttatcgcaatcaacaccttcctcttcttcctcttcttctttctcaccacgcctgccatcatcatgaacactatcgacatgtacaacgtcacccgccccatcgagaagctgcagaacccaattgtgacccagttcttcccctctgtgatgctctggggcttcacagtgatactgcctctgattgtctacttctccgccttcctcgaggcccactggaccagatcaagtcagaatctggtcatggtgcacaagtgctacatctttctggtgttcatggtagtcattctgccctctatgggactgaccagtttggatgtctttctccgctggctctttgacatctactatctagagcaagcatccatcaggttccagtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaagaaccaggccatagacttccagtttgggcgtgagtatgcgtggatgatgaacgtgttcagcgtggtgatggcgtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactggggctgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttaaaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagaccccctaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 461145 - DNA, 613 bp, Homo sapiens
agcagggggcatcttttagcctccccccgctccaccatcctgtagtgaccaggggaggtccagatggagccaactggcatgaggctttgctggttcccctaagagtggactatggaaccttctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 461146 - DNA, 6029 bp, Homo sapiens
gacaggcgcgatgtgggatgtggagggcacatcagaagtaaaggactgtgtgagccagtttgttgcagagatgatggtggccacgctggctcctgaggcacgtccttgtctgtgtgtctcttccagggacgaggatctgattaacaagtgtggggacgacgcgcgcatctacatcgtgttccagtaccacctcatcatctttgtgctcatcatctgtatcccctccctgggcatcattttgcccatcaactatactggatctgttctggactggagcagtcactttgctcggaccaccattgtcaatgtctccacagagagcaagctcctgtggctgcatagcctgctgtccttcttctacttcatcaccaacttcatgttcatggctcatcactgcctggggtttgcgcccaggaatagccaaaaggtcacaaggacactaatgatcacctatgtgcccaaggacattgaagacccagaactcatcattaagcattttcacgaggcctatccaggcagtgtcgtgacaagagtccacttctgctacgacgtcaggaacctgatcgacttggacgatcagaggcgccatgccatgcggggccggcttttctatacagccaaggccaagaagactgggaaggtgatgatcaggatccacccctgtgcccgcctgtgcttctgcaagtgctggacctgcttcaaggaggtggatgcagagcagtattacagcgagctagaggagcagctaacggacgagttcaacgccgagctcaaccgcgtgccgctcaagcggctggacctgatctttgtcaccttccaggactccaggatggccaagcgtgtccgtaaggattacaagtatgtccagtgtggtgtgcaaccccagcagtcctcagtgaccaccatcgtcaaatcatattactggagggtcactatggccccacaccccaaagacattatttggaaacacctgtctgtccgccgcttcttttggtgggcccgctttatcgcaatcaacaccttcctcttcttcctcttcttctttctcaccacgcctgccatcatcatgaacactatcgacatgtacaacgtcacccgccccatcgagaagctgcagaacccaattgtgacccagttcttcccctctgtgatgctctggggcttcacagtgatactgcctctgattgtctacttctccgccttcctcgaggcccactggaccagatcaagtcagaatctggtcatggtgcacaagtgctacatctttctggtgttcatggtagtcattctgccctctatgggactgaccagtttggatgtctttctccgctggctctttgacatctactatctagagcaagcatccatcaggttccagtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaagaaccaggccatagacttccagtttgggcgtgagtatgcgtggatgatgaacgtgttcagcgtggtgatggcgtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactggggctgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttaaaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagaccccctaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctctcctggcccctgcctctctgcctgtgcatctgggccagcctggccttgctccgctgtgcagtggagagaactttctggtccttgagctacccaggaagccagcagggcagccccgaggagcagcagaagtctctggtgagtgctgagccccatgagcaggccactgggctaggctagtggccagacttcaaaacacacagatttcaggtgaggccccaggaagagcggcagacagggctcaggtctgcaagaggatgagggtgggggacttgggggatgggggaggtggaggagaggttgggtggaggagaggttggcacgagggaagtgtgtggggcagccaggtgggataagaaacacccgttagcaaaggctgttataactgtggcaaggagacaacagttccctgccctggcggacacatctcagggtcaggagactggttctgtcccttcctccagcagctgcatgacccaggctggtcacctcatccagacagtagggctgggaggacatgaggcggactgttctgcttcgtgactgagcagagcagatttgagggcagaagatgggaatcttgtgggtgtgttgagtagggggagacttcctcccgcagtgctccctatggggacagaggatgacagtctcagggtggctgcctaaggactctttcctgcgtcatcctcgctgggtcctctccgcaaacttctacggtccatccgtggccactgactcaaagtctaccaaggtgtgggcctgggcgtgggatcaagacccgtccacttgtcccctctccccctcaaaacaattattttccaagtcaagtcagcccttaaaatccacaagggctgcttcgcaggagagaagccatgaagactccctgactggacgggacggggctgcgccctgctgctgcctctcatggtcccctcccaggggccggcagctccagggtccccagatggcaggcctgggacactctgtggttcagcagacctttcgagggccttttatcaggcagagactgagaaagagacagaaaaacaagccgaagagggagggc

SEQ ID NO: 461147 - DNA, 1356 bp, Homo sapiens
gcagagccgaggggccggccagcacctggccctgaccacccccaggccacgcattccttgttacttcacctcctggcggatggcaaccgtcccagcttcgtggactgtcagggtcaccgagagtccagggtggtgggagtcccccacacgagccactggcacactccctgaagcagaagccacggcgccaaggctgtgggctcagggaacttgcccattacctggcagccccgcatctgtgccaaaataagacacaactcagcccagcggagtggacagtgtctgcggccagctctgggatccagggccagctgatgctgggaacagccgtccttgccctgtgcctctccacactgcgagagcccctgcagcccagaggggctccacctcccctgcaatggggctcaaaagacaatccttctacggggctggcaggacagacgtgacaggaacaacgatggcctgctcctcccggaaggtggcttcaagagcactcaggaggtgacagatgctgtcaagaccggcccagggaaggcacagggcaggtttcccagcacccaccacgcgccagcgagcacagagccttcgcctgaaccatccaggcaccgcgccctccccctccgcacacacaggagcccagctgcgattccctctgctccacaggagatgcagcgagcaccaaagagccttcctccaggatcaagcctgatgcagaagtggttacactgactacggcaagcctcctcaacgtgaaaacccggaggacgaaagccattcgtggagacccgctgctgctgcgcgaggcttaagtctattttctcctcatgatctcagtattttcacctgagccctgccggctgttgtgcgctccgtggaaagggagaagcacggtctccagcggctgcgtcaggagtggtgccttgtgcacacctcacagggagagaagtctccaacggactgagcggaggcaaaaagaaaaaacgagaaaaggaaaaagagctgcatacctggcaggcctactgtgtgcaaagcccttgagtgacacaccctatgacccacagcactgtggcaatcccagcaccgagagcgcgttcagcattactggcctctgctttgcccctcagacacatgcttggtcactgggctgtggaacatacaggagccccgtgctccggaacacggaccacccgacaggagcacggacacagcagtcggggcgacgtgggtgcctcacagaagagggaaaaagccaggagggcggcacgtgggcgcaaagttctcagcttcgttagtcatcaagaaaatgcaaactaaaaccaaggggtcttggcctcctagaggaaggagggccccatc

SEQ ID NO: 461148 - DNA, 1146 bp, Homo sapiens
gcagagccgaggggccggccagcacctggccctgaccacccccaggccacgcattccttgttacttcacctcctggcggatggcaaccgtcccagcttcgtggactgtcagggtcaccgagagtccagggtggtgggagtcccccacacgagccactggcacactccctgaagcagaagccacggcgccaaggctgtgggctcagggaacttgcccattacctggcagccccgcatctgtgccaaaataagacacaactcagcccagcggagtggacagtgtctgcggccagctctgggatccagggccagctgatgctgggaacagccgtccttgccctgtgcctctccacactgcgagagcccctgcagcccagaggggctccacctcccctgcaatggggctcaaaagacaatccttctacggggctggcaggacagacgtgacaggaacaacgatggcctgctcctcccggaaggtggcttcaagagcactcaggaggtgacagatgctgtcaagaccggcccagggaaggcacagggcaggtttcccagcacccaccacgcgccagcgagcacagagccttcgcctgaaccatccaggcaccgcgccctccccctccgcacacacaggagcccagctgcgattccctctgctccacaggagatgcagcgagcaccaaagagccttcctccaggatcaagcctgatgcagaagtggttacactgactacggcaagcctcctcaacgtgaaaacccggaggacgaaagccattcgtggagacccgctgctgctgcgcgaggcttaagtctattttctcctcatgatctcagtattttcacctgagccctgccggctgttgtgcgctccgtggaaagggagaagcacggtctccagcggctgcgtcaggagtggtgccttgtgcacacctcacagggagagaagtctccaacggactgagcggaggcaaaaagaaaaaacgagaaaaggaaaaagagctgcatacctggcaggcctactgtgtgcaaagcccttgagtgacacaccctatgacccacagcactgtggcaatcccagggccgcaccagctctctctccttcccctcctcagggccacaccaactgtggggttccagctatcactc

SEQ ID NO: 461149 - DNA, 1551 bp, Homo sapiens
  misc_feature (1)..(1): n is a, c, g, or t
  misc_feature (4)..(5): n is a, c, g, or t
  misc_feature (9)..(11): n is a, c, g, or t
nttnnattnnnacagagctgcctgcaacttgagatgcaaactccaacactcttaatctctgggcacagctgctgtgagcacacagtccctgggactcatatcttgccctgctcctggcctgatgacaagactgggaggaactgtgggcaggtaaggccaaagggaacctcagaccaatatttctctggagggcagagggacaaacagaatccagaggttgggatctaccttggggacaatgtctcagagtccaatggttgcaatgagatgtgttgtgagtcagagctagggagggaaacagcaggcacaggggatgttgaaagttttctggtgaaaaatgattccattggaaattttatatcagaacaagttgaagggaaactcgagggcccggagagaacaactgggctggcagccacggcggggagaagaaaaggaaacacacgatcataaagaactaatcatgaaaaatggaaaataatactttacaaattaaatgttgttggtcttttatttgggggatgccttattagctttttaaaaattagtttttaatagcagcatttgtttaagaaggaagaaaaaatgcttggtggtaccttctggaaggtacattaatcttgttaatgacaccacagttcatggttggcaaaacaggacttttgaatcaacctgtattgtgtgtgtgaatgtgtatgtgcttgagaaagaaggccagggcactaaagatacatgagaagtgcatgaagacaggatgcaggatttcctatgattttatgttgttcttaattaggaagcatattggcagcaaatgctaacatgtgttaggatgtttagctgaagccaaataaatgttttctattacaactctgaattccatgcctggtcggaacccgtgcttttctgctcatggcttacaaaatcccgttaaaagtcatctcaagggccaattttctgttggctcacagagcaaaatgactttcaccacatgttttcctgaagggttatctacaactccgggtggaagtcaaagattggaagaggatgacctctgatcctggaactgcattgcttggtggtcaggaggggttcttagtaagcaaactcagtttaatcccagagtcggaagtgggtgtcaacaagccaaagcaacatcctttcagctctgctgcttttttgtcttggtggaggaatagccaatggaagaagatggagagtccggaccaaaaaaaaaaaaaaaagatgagactaatcttatgctcaatatggaagataatcataactcatcactctggattataactgcttacatatgtctttcttatgagataatgcaccttgaaggcgcagaaggaacacaaagacaaagacaaatggttcttgggtcctgccctcaaggcacttacagtccagtttcagttttagaagttcaaccaagaacatggctaatggctggtagagattgtactgactattataccacttctcctaaaatattattttggttgaaataataaaatgtagattctaaacaaaataaaataatatttt

SEQ ID NO: 461150 - DNA, 2266 bp, Homo sapiens
taaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccaggtcaacagaagaggtgaatccatttaccttcataaccgagccaactgggtgaccgtaggcatctgtttttccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggagcttgagaactgaatcaaacacttcaggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaatgagtccttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagatgctgtctcaaaaaaaaaaaaaaaagaaaaaaaagaaaaatttgctcccaaatccttatattttgaattgctgatatatgggaaaaggtagattttttttaatggtagaaaaagttagttactaatacagacttcatattattacaaataatgtgaaagacttcatcttattacaactgaagtaatgtgaaagttatttggactcttatttactatagcatattatgatgtttgtaggtcttatgaccaaatcttaggactcagtacagcacagattaagaacttgcaaataattcaatagcagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacgaattcaaatccatgtcaacctaatttcataaatcttaactattttaattgtgggtatctattttaaaggaagctagaggattatgcaaaacggtaagattttcaattcataaactcagtttttatggatggggtttcttttctttgggattgatggaaaaatttgttattctcttggtttcacttttctcatttgtatattagtccaacactgttttgtttctaacattggagaatgtgaggtcattcaagctagatctgcagtccttacctgaagatgattttgctcatt

SEQ ID NO: 461151 - DNA, 353 bp, Homo sapiens
gtaaaagatattttcaaactaccttgaccccagtagaaagtgaggcaaatacatccaaggagatgaaggataagacctctgaagaaaagatgcctgattttcagagcacagctctcaaggctgaagaatccaggagcttgagaactgaatcaaacacttcagtgagcccaaattatgggcttatctctgattctttgatattttttccaagatgaaaagagacaaaggatagagattcaagaaaagaagagaaagaaaaatcacataaaatattgggagtttccttcctacccttacccatctttcttttccatgttcctcttaaatattacaaaccaaattccttggaatcc

SEQ ID NO: 461152 - DNA, 480 bp, Homo sapiens
accagcaagactaccatgaggatcaataagcaagatgctctctgcaccccacactcccatgatccgagagatcttcaaaatatgttggatggaggagagtatgccccttttgtatctcctcccatgttagagagcaattttatccaggtaaatcatattcaaggcctgagttaagttccaataacttcagtaattttctcaaagaaaactgaaaaggatggtaggagaattgttttaaatgtgccgagggaatgtgtgatactacaaaagagaacagtttgggaactttaaaaaacctgaaataattacaatgttaaaggacatttacttcaaatgtccccaaaactcttgtgaaggacttctgtcttaactctaccataattgccattccatcataatcttcccaaaattacatgaagccgtttttggcatttcccgccacagggaaacatacagataacttctttcttaggcgtagaa

SEQ ID NO: 461153 - DNA, 2192 bp, Homo sapiens
taaacacctgctaaagaaatgtgaaaagagtggaaacgtgctatttggaggttattttcctagtcgacatccaggagatctccagagatctatttcagccccacctgttgatttcatcatgaaaaggaggaagctcaaactgaagtgagttaaaaacttcatctcctagagaggactgtggctcggcctgagttgagtttttttatgtttatgtgcaagcgcaatgaagaagaacaccagcaagactaccatgaggatcaataagcaagatgctctctgcaccccacactcccatgatccgagagatcttcaaaatatgttggatggaggagagtatgccccttttgtatctcctcccatgttagagagcaattttatccagctccacccacaagatccccaatgtgatgctactggcccatctgacacctggtgcccaaaaagatacagaaaccctgtttaaaagtctcctgacatctcctcctgcagagaaactagtgctcaccaggtttctccctctgcagtttgtgactctttctgtgcatgatgcggagaacatgagcctgaaagtaaagctggtgagtggtcgagcctactacttacagctctgcacctctgcatataaacaggacaccttgttttctcaatgggtggccctcatctccctcttgaatcaggagaaagccaaagtttccaaagtgtcggaggtttcaagtctctcaggaattacgaatagcacagacatcacaggctccatggatgtgacggatgtcaccacgttcacagccatcctgaccccgtacatgtatgcaggtacaggccctgaacatgtcagggacagcatagatttcccagaattcacagacatcaccgacatcacagatgtcacagatcttccagaaaatgaggtcccagaggtcccggatgtaagaattgtcacagaagtcatagaagtcagagaagccacggaagtcacagacagctctgatattacaaactgctcgggagtcacagtggtgtttgaaaacaatgacttaatcagggccaagcaagaggagaaggagcttgagaactgaatcaaacacttcaggcttgtatagtttttcagtttttcccctgattagcatttctttccccattttcactctcctctaaatcacctgttccccttccatacacttttactctcacttaacaccctgtaccccaagaaaagcaaagactggctgaatcttaatacctcattttattaaatgtaattggagtacaaattaaaaatgagtccttctctcccctcatatcaaatctccttctaatttcctcaaacttgtgcctcatctgtctgcccctttctcaagggaatgaatgtgaggaaagaaaagtaaaacagaaaaagacaaagttgatggaaaaacatgtaagacaaactaaagatgctgtctcaaaaaaaaaaaaaaaagaaaaaaaagaaaaatttgctcccaaatccttatattttgaattgctgatatatgggaaaaggtagattttttttaatggtagaaaaagttagttactaatacagacttcatattattacaaataatgtgaaagacttcatcttattacaactgaagtaatgtgaaagttatttggactcttatttactatagcatattatgatgtttgtaggtcttatgaccaaatcttaggactcagtacagcacagattaagaacttgcaaataattcaatagcagacatttgaattaaatgaactgacttctccacctttttttaaaatcagatacaaactactaaactaaaaagcaaacacagctcagggaaagacaatcagtgcaagaggaaaaccaagcagtgtcttctacgtggcagaaataaagcctatgactaatcattacgaattcaaatccatgtcaacctaatttcataaatcttaactattttaattgtgggtatctattttaaaggaagctagaggattatgcaaaacggtaagattttcaattcataaactcagtttttatggatggggtttcttttctttgggattgatggaaaaatttgttattctcttggtttcacttttctcatttgtatattagtccaacactgttttgtttctaacattggagaatgtgaggtcattcaagctagatctgcagtccttacctgaagatgattttgctcatt

SEQ ID NO: 461154 - DNA, 2876 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggcaagcaggggccactggccaggccagggattgaggggccaagagaagtctgggtcggagaatagacaagacaaaccaactgcaagtagccttgctaagacgtttagaaatagcagcctgggctcttcttaaataagactgttctgatgaagagcattctcagggggtcgagtacaccctggctcacctgaattacaggtcaaaatgatatgggttagaaaatgagatgagaacagaagtagaagcagctaacactaggagctgggggtgataaaggaatgacagcagatggagttggcagcgcttcctaaaagatggtagaaggagcaggtttgtgaaggggagggtggataaaggaacagggtgaagttacagagaaaccatcagtgagtgggtggcatttctacccactggagtagaaaggccagaactggcattgccctgagtgcaagccaaggggttcctcctgtctcttctccaactgtaggcctcctagaagaggcaatcacagaagaaaggccttgttggagctctgaccctgaaccctcctcacttttgcccctgtcacctttaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461155 - DNA, 977 bp, Homo sapiens
  misc_feature (910)..(910): n is a, c, g, or t
aaactaggctaggtacgaggctgggtgtgaatcggccgaggcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagatgaganagcccccagggtccaccagtgggaggtgggctgtaaaaaacgtcacaaattgagacagccaccttga

SEQ ID NO: 461156 - DNA, 216 bp, Homo sapiens
aagggaaggccaggccaggagttgagcctgtgaacattatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461157 - DNA, 291 bp, Homo sapiens
gacagggttgagagctttacagaggaagtggacagcatggagggaggtaaggaaaggcctgtaaagaggaggagacactggctctggcggaatggggactattggagggttaagcggatgtggctaaggctgagtcatctaggagtaaacaagaggccttcctttgggaggagccaatccagggtgtagggggcccagagtgaccaggtgcactagggaaaaaatgccaggagagggccaggaagaggaccaacgttgatccggccgcgaatttagtagtagtagtcgacc

SEQ ID NO: 461158 - DNA, 524 bp, Homo sapiens
actcctatcccttatcccagtacttggcacatagcaggtgcccaaaaaagtttccaaaagtgaagggatgagcagtcctgggactctgggctcaccctgcccctcctctctgtgcccctgcagaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461159 - DNA, 2217 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461160 - DNA, 1621 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461161 - DNA, 2147 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagtaaaaaaaaaaaaaaaaactcgagttttttatgttctttttttaaaccccagaaaaacgtttttttaccccaggggggaaactggaaattggtggggggccccctaggggtgtacaacaaggggggggcccccggggggaaaccccgctccaacttggtgttggggggacctccacaccaacgtgtgtgtgtcggggtcaggaaaggcgatccggggcgcccgattggtgtgtaacaccaggagcggccccccaaaagggggttttccgggacattgagaagccaattcggacactcgtgctaagcccccttagaggagacagtaggctccccaacaggagggtttccccgggtcaaaagaggcaggagcggtggctactggaccccttaacaaagcgtacaataaagtggggggtccatataacaggcacccacggacgtgatcgtacgatgggaacacaggacgcagaccgtagatggcaagggagcacgattaactcaacacagacacgggtacagcacatgag

SEQ ID NO: 461162 - DNA, 2025 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagtaaaaaaaaaaaaaaaaacaaacaacaaaaaaactttgttcgggcgcggcttagggcctctagagaaaaggtcttttatagaaccacttcgcggtgggagggggcgcggggccccattgtcggttcttgtacaccctgtgggcacatagctgggtccaccaaggagagaacccgcggggaccatgagacaagggggcggcggagagcttcctccacccatatataaaaaagggcccggggggggcacccccaggacgcggtttctgagcaaaacaaccctcacaaatgggagagctccccaagggagggcacaacaaaagggggagcccctataacaaagcggaggagtgccaaaagcgaggcccgcgaattttaaaattaagcccgccgcccggggggggaagc

SEQ ID NO: 461163 - DNA, 2026 bp, Homo sapiens
aaactaggctaggtacgaggctgggtgtgaatcggccgaggcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461164 - DNA, 2000 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttctggaggaagaggctgagggtgatttggagataaaggtagaggtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461165 - DNA, 2017 bp, Homo sapiens
tatgctaggtacgagctgggttaaatggcgagcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461166 - DNA, 1481 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttgtgatagccttgaccagcaaccccgagctgtgt

SEQ ID NO: 461167 - DNA, 1502 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgcctacaaaacgcgggcgtggtgaagaaattcatgactatatatagttgtgagctaggacagcagcagacccgagctgtgtaggtaccgagctgattgt

SEQ ID NO: 461168 - DNA, 1577 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461169 - DNA, 1193 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgaggaccatcgttggggtacggagc

SEQ ID NO: 461170 - DNA, 1169 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagatgaggaaagcccgtggtccccaccacctgccgggttgggcgtgagaagcccacagataagacatccctctgatc

SEQ ID NO: 461171 - DNA, 1981 bp, Homo sapiens
aaataaggctaggtacgaggctgggtgggcggaacatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461172 - DNA, 2162 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461173 - DNA, 2153 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461174 - DNA, 1888 bp, Homo sapiens
tatgctaggtacgagctgggttaaatggcgagcaaagcctgagtcctgtcctttctctctccccggacagcatgagcttcaccactcgctccaccttctccaccaactaccggtccctgggctctgtccaggcgcccagctacggcgcccggccggtcagaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461175 - DNA, 1303 bp, Homo sapiens
  misc_feature (1)..(1): n is a, c, g, or t
  misc_feature (7)..(8): n is a, c, g, or t
  misc_feature (15)..(15): n is a, c, g, or t
  misc_feature (26)..(26): n is a, c, g, or t
nttggcnntgagcgngtttttacacnaccagcgacatgattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461176 - DNA, 1216 bp, Homo sapiens
caattcagctcggtacctgtaacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461177 - DNA, 1244 bp, Homo sapiens
  misc_feature (871)..(871): n is a, c, g, or t
  misc_feature (900)..(900): n is a, c, g, or t
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgaattttggaaccaccaatatcacacgacttgncaaaggcagtgggggagacagagatcganggggctcctcaaaaggaggagctggcatcctttcatgaaacgcaacagaaccaacgaaaacgcaggaagtaaacaacaaacggggccctaaaccaaaaaggccccagatttggccccaaggctttcctgggggcctttgggaacccgggtggccaggcttaagcaacttttggccccccctctagaacaacttcccttccaagcgggaaaaaccccatattcgaaccccaaaaaaggaaattccacttggggggccatatcggaaaccaatttccccggtgggcccccaaaagtacttggaaacggaagactgtggcccttccggcggcaaggaaaacccgaag

SEQ ID NO: 461178 - DNA, 978 bp, Homo sapiens
aaactaggctaggtacgaggctgggtgtgaatcggccgaggcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagatgaggaaagcccgtggtccccaccacctgccgggttgggcgtgagaagcccacagataagacatccctctgatc

SEQ ID NO: 461179 - DNA, 244 bp, Homo sapiens
attcgtggtgctgctcggcgaattcgtggtgctgctcggcgaattcgtggtgctgctcggcgaattcgtggtgctgctcggcgaattcgtggtgctgctcggcgaattcgtggtgctgctgagacgacgctcacagagctgagacgtacagtccagtccttggagatcgacctggactccatgagaaatctggtgagtgccttcacatcagctgcccagctcctccttcacttggcctcagacc

SEQ ID NO: 461180 - DNA, 1724 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagtaaaaaaaaaggggagataccatgatcacgaaggtggttttcccagggcgaggcttatccattgcactccggatgtgctgacccctgcgatttcccgtcgacgc

SEQ ID NO: 461181 - DNA, 2140 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttaaaaagtttccagagttcaaaaaaaaaaaaaaaaaaaaaaaaaaaaaaaaaaaaaaaaaaaaaaaaaaaaaaaaaaaaaaaaaaagagagggggggcgcgcgccaaaaaatcccccggggggcccaaaaaaaaagcggacccccatttttgggaaaaaaggggggcccaccaaagggaggagaggagaatatatatataagacgagagagagcggggggccgggaaataaacaacagggtggaacagaggcgagaacaaacaaaaaggagcgcaaaaaaacgagagcagaacacacacaaaacaacaaccgaagacgcaacaaacaaagacacccacaacaccaaccacaaaaaaaaacaaagcgcaagagaaaggagacaccagcagaggccgagaaaccaaaaaacaaaccgcgaggagagaaacaacacaacaacgcacaaccagaccaaacccccaccaaagacaaagcgacagaacagacagaacaacacaaacaagacaacaaaaaagacaa

SEQ ID NO: 461182 - DNA, 2302 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461183 - DNA, 2021 bp, Homo sapiens
aacataggtcagtacaggccgggttatcgtcgcaagcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461184 - DNA, 1958 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaagtgagtggggctctcctacccacacgtgctgggatcaggagatcacttctccccaaagtctgagcttttggaagcaccccatgtgtctgttcactggtatccactgagcactgggccgttgctccgtgggtgctcctgtgtcttcaagggagtaacagttacagaggtctcccccttgaagaaagcaaactaagtattgtccctagctgtacttagtatgcaaatgaagtttggccttgagtttcccttttgtcaggaggctttttccctctacctttcttgtctcccttctactccacggggctgtttataacttgggcttggtcttctgttacagtcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagt

SEQ ID NO: 461185 - DNA, 1480 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcattggtgatgccttgacagcagctcgcacaagag

SEQ ID NO: 461186 - DNA, 1224 bp, Homo sapiens
  misc_feature (1147)..(1150): n is a, c, g, or t
  misc_feature (1152)..(1152): n is a, c, g, or t
  misc_feature (1157)..(1157): n is a, c, g, or t
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagtgggggacccccgggtccccccagctgtgagtgggtggtggaaaacccaaacnnnnanaacanctgggaaacggagcgaaattaggccttgaaccaggggggccgacccaagaagaaagatcgcttaagg

SEQ ID NO: 461187 - DNA, 1171 bp, Homo sapiens
  misc_feature (1104)..(1104): n is a, c, g, or t
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagatgggggagncccagggggcacaacagctgccgaggtgggagaccggaaggaagccaaagggaggagaaagcaagcg

SEQ ID NO: 461188 - DNA, 1357 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcaggtgcgtgaggggaggggatggctgccaaggtgtgggagggaggcagacggaatgaggggcctgatggactgtccccatcctgcagattgaggagagcaccacagtggtcaccacacagtctgctgaggttggagctgctgagacgacgctcacagagctgagacgtacagtccagtccttggagatcgacctggactccatgagaaatctggtgagtgccttcacatcagctgcccagctcctccttcacttggcctcagacc

SEQ ID NO: 461189 - DNA, 1960 bp, Homo sapiens
cgacaaatatgcagtcgggctgtgtatcggcgaggcccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461190 - DNA, 2052 bp, Homo sapiens
agctttctacactcatccgtaaggccgcgagtcctgtgctttgttctttgccccgggtcgtatctgtttcctcaagtacgattctggctttcttgcactacgatgcttgcgattcctctgcgactctgatccacgggccccgcggctacgggagccgctgtctcgggatcaagatccagcatggcagtctctcgtaatgtctatgcagctgggatctcatctaggtgcgccgtcctctccgatgctccagtatcaaattacttccacggcgggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461191 - DNA, 2163 bp, Homo sapiens
ggtgaaagcaggagagacccctctgactggaacctcttacctcccagaagccttggctgcgcggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagctacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccggggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461192 - DNA, 1239 bp, Homo sapiens
ttaaacgaggcgtctaggttggtcggcggtggtcggcggcgctctggaacaggaggaagctcagccgatgcagccggtgccgggaggtgtcccaattcgactcgccagactgcgaatggcattgcggtgtcgaaacgagagacaacgtcgtcacgatggaagacaagggtacaacagtcgtgagtgagctgcggagaccccgagcggacgtcgtccgtctggaacgctgacccagagaatctaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461193 - DNA, 922 bp, Homo sapiens
tcatctagaggatcccgcaggtttaagggctaccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtcactttgtcttcttttggctgttttcattgtgcacaaatgccctaacccaacagtcccatccctgatccagcagaaaccacctctgacccctgagggtttcatatagattggggtgtagaaggaagagggatctgtattcttggaaacacttctgagagacagaggagggagcagtagatgtgatgggtcacaggctgtggggatccctacaagggaattgtggaatctttgccttgaagcgatctggtgttcaaaaggtccctgactgatcattagcagaaatctgaaccagaggaggaaattaggccaaagacagaggacagaggagacagggagacacatctggccctcccctaccctgctgctttatgcccttggcccactgcccagggcttcccacccacagttttttcctccaaccccaggccatactcatcctccaaacctatggtgccctcaactctgttcattcactcaacggagatatgatttttagggtgctagaggtctggctagaagttgagtaaatgatcatggaagttcccatctaggaaagaggtgcccctgagtaagcacccatatag

SEQ ID NO: 461194 - DNA, 1654 bp, Homo sapiens
cacttataaatgggcatcagaggttctattaaccagtgggagcttcccctttattttcctggggcagtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatat

SEQ ID NO: 461195 - DNA, 1158 bp, Homo sapiens
tgccgtgattgtaagctagcgatggatgaagaggtgttgggtgctgaaacagcagctgaatggctgctgggcttagcatggctgaggtggcatcatgagagagaggctggggatgatgtgacatggaccttccccgccggaaatcagtcccgcatcaatcccgctgagcccggcagcttcacttgctgtgaactgaggacagctgcaggaaaccttggaaagaaggtggcctggcacgggggtgccaggtggctggctgtggctgtggccgcacatgcttacagcatcaagccttggaaccgcaggtgcagcgggctggcaggtgaggaggaaggacgagctgtggggctgtcctgccagggcctttcaggcctctggctgtgctccgacttgaccattctgctacctgctggtcttgagccccgggcattcagtggaatgcttaacttgtacatcagcaaggatgaagcagggagcgacccatcccttggtcagactgcatctgcacagatgccctgtcagaaaacttgttatgccctggtaaaaagttaagaattataggcatcaactgtttcctgccacataactgtcccatgatggcatgggtacttcttgggttaataatcaggtgttggctttcctgcaaaggctgattatcacttgtcaaattatcactgctgaattgtttaatcaatggtggcttttgagcttgagcctgctgcatgcacagcagtgttctaggacttccaagaggaacagagggtgaccaaggagccatttttaccctcaagaagagttatctagaaggagggtgtgtctgcacagcttaggggtcagcgtccccacagcagctgcataggcagatagatgcacatagcctggcccaggggaggtgctcaggaaacacttgttgatgattgaggaaagaatgggttatttctctattaatttttggctctgggactcagggaaggcaccagagagaaggtgacattgatctgggatggtcggatttcagaggtgaaactggcctgaaaggaaatgccacatcaccatgtgcatctcattagaagtaaaaggagacatgtaggaaaccttagatttgtttttggtgaagtgaaagagagaagttgctctaaaaggttggaaaccagcccc

SEQ ID NO: 461196 - DNA, 1084 bp, Homo sapiens
agctcgccctcgggctctggggaccgctccacagcggggcctcccggaattccctgccggtctccgcgggcacacttggctggctgctgcgaccaaaactaccttcgcgtggcagggtcctccctcctcctcacagacaccccgacatcaccctcaaaactggaagggacaaccccgagtgatctaggcgatggtggatacctgaaagccacccatggaaaaggtgaagaaagtgccccctggttctcagaagagccactgctgctgttgtgagcagatatcggatggtgtctctggctgcatcattcgtcaaccacacatattcatatgagtgttaccctccagcactgtgccttccaaaagcccctggctgaggaagcactgcttctgagccacagagacagctgatttatggaccattttatcaccgcttctaaactgtggctctaaacctaacacagagggtaatggtagtgctgtatccattcattcacccaataaatatttgctgagcaccatctgcatatcagggaatgagaccacccatgaagaatgcccaggtggacatgagaagagggcagaaccctggagaacaacacttagaaagggacagcaaagaacaagaacccctgaaggagacaaagaaaatggtcatccaggaacgaggagggcctggagtatatgacgttgaggagtcctttgccatggtccacacaagcatttcccaaattcttgggcctcctgagaagctcatgaagcccatggtggtgaaattgagttggctgtccctactccgatgccccagccagcagcactcagccatcacccaccaggatgaattcctccacaccagcttctgcttcactggaacagtttgccctagggtcaattcctctctctcccaccagagaccagtgaggcagggcaggagacactcagcagtttccctcgtgcgggatctctaataagaggctggcagaaaagttcctgtgcttcccatcctctgcccagctctagggtctcaggtgagagaatatctggcctgtctggttcactcttttttttttttttttttttgatagag

SEQ ID NO: 461197 - DNA, 820 bp, Homo sapiens
  misc_feature (13)..(13): n is a, c, g, or t
  misc_feature (23)..(23): n is a, c, g, or t
ccctagtaacatngaccaacggngagaaaagggctacattatggcacataactagacaagctatatagatgcatgtgaaggctggtaccacaaataaaaaggaaaaaaaactcagtttgatgaggcaggataccatgctgtggagacccatttggcaagaaactaaaggcagccaccatccaaatgctaggaaaaagctacagctttctgtctgatggcaaaggagacactgaatccagtcaacaataacaggagtttgatggaagatccattccccagtggagcctcagataacacctcaagtctggccaacattctgactgtaaacttatgagagaccctgaagcagagaattcagctaatccatgcctgggtttctgactctcaaaaattctgagataataaatgcatgttgttttatgcctttaagttgtggtaatttgttatgcagctgtagatgacatgcagattcaagtatctgaaaatgaggggctgctctgaaaacactacaaatgtgggagtggctttataatgagacagtgaacagaagataaacaatttttgaaaagcaaaccgctgacaccgaatccagggataaccccacgacaaacttttaccaaaatacactaaacggccaaccacctgaacaagccacttactagaatatttacaaaatctacacccagtaaaaacaatcccctcccccccttcaccacgggggggattatccgacgccttctttatggggggggttgctaacgaatttcttttaaccctactaggtgcggattacctctacaagccacccgccatcctttct

SEQ ID NO: 461198 - DNA, 1177 bp, Homo sapiens
ctcacctcatcctgccaactatgccaaatgtcagacgtataactagactaaattcctggcaagcgtctagaggagacctccagtctttcaccaaggtaactgtgcactggggaaagggaaattatcaaacattgtggggacaactgtacactggctctgagctgacattgattccaggggacccaaaacattattgtggtcctccagttaaggtaggggttcatggaggtcagataattaatggagttttagctcaggtccaacttacagtgggtccagtggattcctggactcatcctgtggtcatgtcaccagtgccagaatgcataattggcatagacatacttagcagctggcagaaactccacattggcttcctcagtgaacatgtcaaggggaaaggcaattatgccatactgcaagcaaatgagctgtgaagctggtccagaaataaaaaggaaaaaaaaatcagtttgatgaggcaggataccatgctgtggagacccatttggcaagaaactaaaggcagccaccatccaaatgctaggaaaaagctacagctttctgtctgatggcaaaggagacactgaatccagtcaacaataacaggagtttgatggaagatccattccccagtggagcctcagataacacctcaagtctggccaacattctgactgtaaacttatgagagaccctgaagcagagaattcagctaatccatgcctgggtttctgactctcaaaaattctgagataataaatgcatgttgttttatgcctttaagttgtggtaatttgttatgcagctgtagatgacatgcagattcaagtatctgaaaatgaggggctgctctgaaaacactacaaatgtgggagtggctttataatgagacagtgaacagaagataaacaatttttgaaaagcaaaccgctgacaccgaatccagggataaccccacgacaaacttttaccaaaatacactaaacggccaaccacctgaacaagccacttactagaatatttacaaaatctacacccagtaaaaacaatcccctcccccccttcaccacgggggggattatccgacgccttctttatggggggggttgctaacgaatttcttttaaccctactaggtgcggattacctctacaagccacccgccatcctttct

SEQ ID NO: 461199 - DNA, 1477 bp, Homo sapiens
gatgctatgcgaccacggaggcaggaactggagggatgtggctacaagccaaggaacatcaagactgctggcaacacaaagagctcagggacaggcatggaaccagttctccccaaggacattcggagatgtggccctgctgccactgcaatcttggacttctgcctccagaactgtgctgatgcagagtctcagggtgaaactaacatgggccaggctacccaccttaataagccggtcactgttggcacagttgttgatgatggacagggactgctggaatctggttcccccaatgccaacaacatcttgcagtatctttatgacaaggaagtagagcagctgggaggcctccgtcctgatggagctcagcttggagttacagcacttgagaatctcgtaacacagagccgcacacatgtccgctctcccttcatagaatgttgagggaaactagacaggatgagaggaagcagcagataaaccacagacaggtcagtgctcggtaatgtacccttcaattccgggggaagaaggaaaacatctaaccactgcccatgaagcaacttaccttataaattaaggaccttaaggcagtgaagacattttttaaagccgtttcagactgatgtttttgaagaaaacacaggtagacatcaaaaacttttttcatgagaggattatgtccatggtcggccaggagctggttcttaaaacacacattgacggctttgttagacataccagtcacctctagtaggtttcacacaatttcaggctcaagaattacattttctaagtattaagacaacttatactttaaacaaactctgccttgaatcctctaggaaagtacagaattcttttgtagaacaagcaaatctatcaatacatttatgttttggggatgaacctcccagcaaactaacagagttgaaaggaacacttgcttagtactgactgggcttctatttattaatatgtactcatttttactgtccaccagcagctgatacagaggtgccatttgtgacatcttaattccaacagagaagtgccatcacaggtccagtgaattgtgaatctatcacagctggcagaacacctggaattcacagtgatctttctatcatgaaatactaagatgcttgccaatcactaagacgacctaagcctcatgtgtctgccgaccaggctcattgttgtgcaaagcagatcacaagctgcctcgcaagcctccggtgcccatgtgctcctccctgtcttggttcctattgctcctgattatgtgttagtcctcactgtgcagttcaaatcaagaagaggcactaaaaatggaactgctaaaaacacatttccagattaaatctgtgaacacattaaaaatattataaactacttgaagtccagcattggtttgggattgtgttaataatagacattagaaaaaccagatttttctgcatgtgacaacctg

SEQ ID NO: 461200 - DNA, 1255 bp, Homo sapiens
cagccactggcaccccatgcccagcaaggaagtgggcttcaagcagcctcaagaggagtctttcccatggcaggactccccaggagagaggcttcctcctcacgccactttgtcctctggcagcaacaagtctcaggggctgagctgcctcccacccctctgggggccactctcctgctgacacccagctcggcacaactgttccaccaagacggtgtccacaaatgcatccccaaacgacaatgcagctttcaagttctctagggactgctgtattttctcatgactggagaatcactgcacctttctgggccccattgagtgacagaagatcggaatggatagtcacatgcctgccccagcgtggaaggagaagagcctatacttccatccattctggcctcttccaagttcccctcatttttctctctaagatcaaataaataaacatgttgttattctttttatacatttaatatatgctcatgaaagaaaagtagcaagggccagggctttgtgcagcctcagctgagagccctggagatgagggtgaagggagggcggcagccacagggagctgggcgggtgggactctgccagggcaacggggggtgggcagcagagagggcgggctccagcttgactctgccctcacctctgggaggctggtgcctcttgtcagctgcccttccctccccccatcccccagcctctaaggcagcgaccacgtggggaggaactagggctcaggcgcagctgctgtgtgccaagaacttcgatgcgttttcttactgcgtcttcacaacagccccaggagggcggtgctgttttcattatccccattttacagaggtggacacggcggcgcagcgagcgtcttgctcaagggcaaagaataaggaggtaagccgaatgctcagggagggtcaggaactcagacatctcctggcttactggaagcttatgcagcagggagctggaagccaagctcgggtgtttgtgagaagcaggtgacccaggactttgtggctggtacctgccctgagttcttccagttgcactgtcctggataacccttctggaaccttccaaagaggcagaaactggtcgctgtgctggaggagtgaggagtgggtgtgcatgcagcctgaacaatctccttgtcccccagctgctgaagcctgtcacctttctaaggagttagtgcccaggaaccagcttttccttaataaaagaactcaaatgtattgagagc

SEQ ID NO: 461201 - DNA, 1957 bp, Homo sapiens
gacaccaggaggacatgcctgaactgggactgtcccagcaccaggcccaacttctagcctgttcccactgcggcacttctgcctacaccccccttctttgcatggctggcccaggtctcagcatgaatctgcactccccagaacagcagcagctgccactagataggaaggaccccacctctggtgtccttggggaaaggggccttgcataggcggtgacacaagccacttggtcccagctgcgggtgaggggaggggctaacacttccagaagaccctgaactctggcaggcctgattgctttgctccagggctggtctcagctgctatcatggatccctgggagcagctggagggaagagagatggcatccagcgccgatcgatcgtgggaagaagctggcccctttgggagcctccttgtgggaaaagtccatcagcccttagggagggccgggcatcacctggagctggcgctagggagagaggccaaggcagtcaatgaagagccttgccagcagggtatgcatgattgtctccattttatggatgaggaaactgaggctcagagaggcgtggccaaacttgtcgtcagcagagttggggctgagccagacctcgcttgtctgacagtccacgtgtccccatggcttccttcacccccagcccagttgctgctgccatcatgggtgttggatggggttatccagctgaacctgtactcagctagcctggtgggcttcaagcagcctcaagaggagtctttcccatggcaggactccccaggagagaggcttcctcctcacgccactttgtcctctggcagcaacaagtctcaggggctgagctgcctcccacccctctgggggccactctcctgctgacacccagctcggcacaactgttccaccaagacggtgtccacaaatgcatccccaaacgacaatgcagctttcaagttctctagggactgctgtattttctcatgactggagaatcactgcacctttctgggccccattgagtgacagaagatcggaatggatagtcacatgcctgccccagcgtggaaggagaagagcctatacttccatccattctggcctcttccaagttcccctcatttttctctctaagatcaaataaataaacatgttgttattctttttatacatttaatatatgctcatgaaagaaaagtagcaagggccagggctttgtgcagcctcagctgagagccctggagatgagggtgaagggagggcggcagccacagggagctgggcgggtgggactctgccagggcaacggggggtgggcagcagagagggcgggctccagcttgactctgccctcacctctgggaggctggtgcctcttgtcagctgcccttccctccccccatcccccagcctctaaggcagcgaccacgtggggaggaactagggctcaggcgcagctgctgtgtgccaagaacttcgatgcgttttcttactgcgtcttcacaacagccccaggagggcggtgctgttttcattatccccattttacagaggtggacacggcggcgcagcgagcgtcttgctcaagggcaaagaataaggaggtaagccgaatgctcagggagggtcaggaactcagacatctcctggcttactggaagcttatgcagcagggagctggaagccaagctcgggtgtttgtgagaagcaggtgacccaggactttgtggctggtacctgccctgagttcttccagttgcactgtcctggataacccttctggaaccttccaaagaggcagaaactggtcgctgtgctggaggagtgaggagtgggtgtgcatgcagcctgaacaatctccttgtcccccagctgctgaagcctgtcacctttctaaggagttagtgcccaggaaccagcttttccttaataaaagaactcaaatgtattgagagc

SEQ ID NO: 461202 - DNA, 1415 bp, Homo sapiens
tctgaactcattgttctcctgtctgaaatccttcagtgcctccctgtcatctccttgtgatgaagtccaagttccttaggaggatagcagctgctaaatccatgaggagaaatgttgataagtctcaacccctgatcaatcgtagcaacacgaaaagagggacatctgacattgaatgcatcactacgatagattcttaccagaataatgaacctgaatttgatcatgcctctgacataactaccagtttccaggaaatacagaggatagaggagatgttaaataaaaccataatacagcaaccagccaagaccagaatgtttgaagtgtgtgctatgcatagtgacgtccttccaaagagtcgtatgggaaagcagggaaaaaagagaaactttacagtgaagaaagctaacaagcactacttcatccaggggatcaagggaaccgcctccaagaaacttcatgctccagcaagaactcataaaatcaaagatgtgcttccatatgcaataacttacccagaacaagtgatgaaagcttccttcccattaatcactggaagtgcagacattgcaaagcccatctcccttcagaactaaagccacccctctgatagctgcatccctcctagggagaaagaactccagtggctgccaagagcccctgccagatgctcctccccaccaccctggcatcttgtgcatagtagatctcgggaaatgcctccatcatgactgctattggaaaggaaggccaatctcctgtttgttgcccagagtgctggctgtgagtcacctggagtttcctagaggtgggatttcgccaggttgcccatgctggtcttgaactcctggactcaagtgatccacctgccctggcctcccaaagtgctgggattacaggctatatattgctaaagaaagaaaaagcaccaatggctgaagctagagagaccttgctgaggaaaagggaaccaaaaatgggaaatagcggcctggtaaagaggtgtggccagaggacagcatggagcacagccaggagaaactgctctgggtgaagagccagatctgctctggaatgcagcaaagagctccttcctgctttctcagcccctgcagcagctcctgcttcactccaagaaaatgccagccccctaagaacctgtccctttggaacagtggatccaaaagctgacccaagagaccttgaacttaacacctctgtgtcatgggctccttaatgatagaaagaagattgctttagaagactggtttgcaaaccagtctgctgggcactagaagccttgggaagatttgaaaaataaatcttattggcctcaccatttcacattctgacttagagggtgtgggctctctaatctgattgtgtttttttctgtttttgtttttgttttt

SEQ ID NO: 461203 - DNA, 1382 bp, Homo sapiens
tctgaactcattgttctcctgtctgaaatccttcagtgcctccctgtcatctccttgtgatgaagtccaagttccttaggaggatagcagctgctaaatccatgaggagaaatgttgataagtctcaacccctgatcaatcgtagcaacacgaaaagagggacatctgacattgaatgcatcactacgatagattcttaccagaataatgaacctgaatttgatcatgcctctgacataactaccagtttccaggaaatacagaggatagaggagatgttaaataaaaccataatacagcaaccagccaagaccagaatgtttgaagtgtgtgctatgcatagtgacgtccttccaaagagtcgtatgggaaagcagggaaaaaagagaaactttacagtgaagaaagctaacaagcactacttcatccaggggatcaagggaaccgcctccaagaaacttcatgctccagcaagaactcataaaatcaaagatgtgcttccatatgcaataacttacccagaacaagtgatgaaagcttccttcccattaatcactggaagtgcagacattgcaaagcccatctcccttcagaactaaagccacccctctgatagctgcatccctcctagggagaaagaactccagtggctgccaagagcccctgccagatgctcctccccaccaccctggcatcttgtgcatagtagatctcgggaaatgcctccatcatgactgctattggaaaggaaggccaatctcctgtttgttgcccagagtgctggctgtgagtcacctggagtttcctagaggtgggatttcgccaggttgcccatgctggtcttgaactcctggactcaagtgatccacctgccctggcctcccaaagtgctgggattacaggctatatattgctaaagaaagaaaaagcaccaatggctgaagctagagagaccttgctgaggaaaagggaaccaaaaatgggaaatagcggcctggtaaagaggtgtggccagaggacagcatggagcacagccaggagaaactgctctgggtgaagagccagatctgctctggaatgcagcaaagagctccttcctgctttctcagcccctgcagcagctcctgcttcactccaagaaaatgccagccccctaagaacctgtccctttggaacagtggatccaaaagctgacccaagagaccttgaacttaacacctctgtgtcatgggctccttaatgatagaaagaagattgctttagaagactggtttgcaaaccagtctgctgggcactagaagccttgggaagatttgaaaaataaatcttattggccccaaaaaaaatataaaactgggcctcgttggcctaaacggttgaac

SEQ ID NO: 461204 - DNA, 1682 bp, Homo sapiens
tcgtgccgaattcggcacgagagaacatcagtaaacagataagaagtaggagacaggattggcattatatctatggtcatgtcgaggagggacaagattgagtggtgagaagattagaatttggatagattctaaggccctggcatgactctacagggaaccagggaagtgatgtgtctcttcttcagtgcgattctctctccgaagatagctttggcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctgatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaatgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaact

SEQ ID NO: 461205 - DNA, 3230 bp, Homo sapiens
ggacaagtaagctctcggctggatttaaaggtttagggcaggaagacaagtacttattggctcatgacttatggatttgagctttctcaactgcacagaaatgacttaatgctgggaatatttgagtcaccaaggggagatcctctgggtctcgcaaaggaaagagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctagtaaacagataagaagtaggagacaggattggcattatatctatggtcatgtcgaggagggacaagattgagtggtgagaagattagaatttggatagattctaaggccctggcatgactctacagggaaccagggaagtgatgtgtctcttcttcagtgcgattctctctccgaagatagctttggcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaatgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaact

SEQ ID NO: 461206 - DNA, 1002 bp, Homo sapiens
tgcaaatgagtccgcgtgatggggacgtggcaactgactgacgggctttctctgaagtggagaaggacatctgtgttttccatattgcggaacaccggatctttccaagtcacacatttgggaagacagctgaattgccttcaagttcctcctgttatggtacaaatacccacctggtgtgcaaacatgagagacgcagctttacactagaaccaatgaaagcaaatttgagaaaacccaactctttaggaatggagactacagatgtatgaggggatcttaataattaaaagaagaaaatatgtaaacaggaaaaatatccaactgtcacaaaactctacactaaatcaaactgcaaagttttgtctttttaaaaatatagtcatgtgccacatgacaacgtttcaatcaaggaggggctgcatacacgacaatggaggaattccagaagaaagcattgttatcataggagatgacagctccatgcgtgttattgcccctgaagaccttccagtgggagaagatgtgcaggtgaaagacagtgatatcgatgatcctgatcctgatccattacacgggaagaattccgctgaagacaccacaacatttattgagaacatcttagagcaggactcaaactgcgaacaaaatggaaaatgtctcaaagagctcccaaaattaattataaaaattaaaagaaccctgaaagaaaagctgctgtgtggagaagatggaagctcagaggtaaacccactggaaagtggttaaaggtacagcattaaaagttactaatcgggggtgggggaaaaaaagcccatagatgaagaaacatgttaggccatcttgaacgtaaatgcgagcttctaaaagaaggttaaggaacacagctttggaaatgcatactttttttccgttggttttctttgacaaaatctggcgacctgtgccaacaagacctgccaggcagtgtcagattgaggaccatggaaacttttaatgatt

SEQ ID NO: 461207 - DNA, 7180 bp, Homo sapiens
  misc_feature (7)..(7): n is a, c, g, or t
  misc_feature (9)..(10): n is a, c, g, or t
  misc_feature (12)..(13): n is a, c, g, or t
  misc_feature (15)..(15): n is a, c, g, or t
caggatncnntnnanccagtggagatatgctgaaaggaaccagttcagtcagtagggatgttcgagttggagttactcagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaggtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatcattcttgtatttttaaattattttaccaacaaaagatggcagtttctatgggaatagattatatgcttagatattaatgagtctagttgtaataaagcagttgcatattaattagcttggtaacgttacaaattaaaaatgttgattagcaacttggatgaaaccatcaaaatggtataatatttgtcttgagcttaattttttttctaagaggagaaatagagacaaagctactagttaagtcattctatttagcccattgcttaaaagcttatgtaaaataacactggatataacacctttctgttaataaaatattgagtctaaattttatataaaacaaacttcaccgtcaacttaagggaacattaaggcccttgaaaagatataagtaactactataaaagaggtatgatggtgaggtttgggcttaaaatttatttatttaaaaaaaaa

SEQ ID NO: 461208 - DNA, 2898 bp, Homo sapiens
  misc_feature (7)..(7): n is a, c, g, or t
  misc_feature (9)..(10): n is a, c, g, or t
  misc_feature (12)..(13): n is a, c, g, or t
  misc_feature (15)..(15): n is a, c, g, or t
caggatncnntnnanccagtggagatatgctgaaaggaaccagttcagtcagtagggatgttcgagttggagttactcagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctggtaagtattggacattatcagttaaaataataaaattgaaatttgaaactttacataaaattgtttaccactgagaattcatcagtcttgtctaactagctggattctgactgtctgattgttgcttttcttcaaatgaagattgtatttctagtgttttagaattctctgtaatttgaacaatataaatccaatacttaagcctgctctttttccctttggctgtcttagatgactttcctatataaaacaaattaaaaagtaaagttattgtttatgcccta

SEQ ID NO: 461209 - DNA, 1483 bp, Homo sapiens
  misc_feature (7)..(7): n is a, c, g, or t
  misc_feature (9)..(10): n is a, c, g, or t
  misc_feature (12)..(13): n is a, c, g, or t
  misc_feature (15)..(15): n is a, c, g, or t
caggatncnntnnanccagtggagatatgctgaaaggaaccagttcagtcagtagggatgttcgagttggagttactcagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagtaagcatcgactgtttagatttgatagttgccctctgattatgtaatattccttaagtacattaataaggcaaatttctgtagttggtgaatgattttatggaggaaggcaatcagttagttatatgatttttttttaggctaggatcttgaaagaaattacatattaaaagggaaggaaaattttaggggaataatctaccttacatacaggcagatttaacaagaaattaactattaagcctcttaaccttttcagctatgcattttattggtttgttagagtattctgtgttcgtgagaaccagatgcttctaacagtttcagttttttgtttgtttatatttttcataagtttgagttatacgtatatgattagaacatatagagaaaagccagtatataatgtgagcacttgtaatttccaaattaataaaacatgtgaaagttctttg

SEQ ID NO: 461210 - DNA, 7153 bp, Homo sapiens
  misc_feature (7)..(7): n is a, c, g, or t
  misc_feature (9)..(10): n is a, c, g, or t
  misc_feature (12)..(13): n is a, c, g, or t
  misc_feature (15)..(15): n is a, c, g, or t
caggatncnntnnanccagtggagatatgctgaaaggaaccagttcagtcagtagggatgttcgagttggagttactcagccttgcgtcaccgtcacaccctaaagccacccaaactcagatcgatgccgtctgctgtcgccgttgtgtttcatttattcttcgaactactataggtggtcttcttggagaaaaggctcagcttgctgctgtaaaggatatttgccaggccatctggaagctaaagaaagttatggatgccgtaatgagtgatggtaatttggaaacccggcttggttccacagatgtagccgctagccaacatatgctggtttgtgctttacaagaacttggaaatctcatacacaatcttggcaccacagcggcacctttgctacaggattcaagtacaggtctccttgacagtatcttgtcagttattcttcatcctagcatttctgttcgactagcagcagcttggtgtttacactgcattgccgtggcattaccctcctacctaacaccactcttggatcgttgccttgaacggcttactggacataagtcttcacctgaagcagtgactggcttcagttttgctgtagcagctttgttgggagcagtaaaacattgtcctttaggaattcctcatggaaaaggcaagattattatgacattagcagaggatttgctgtgttctgctgctcaaaacagtcgcctttcagctcagcgcacacaagctggatggttgctgatttctgctctgatgacattaggtcctgcagttgttagccatcaccttgctcgagttctgctgttgtggaagtgtgtctttccagcatctcctaaagatctagaaacagaaaagagccgaggagattcgtttacatggcaggtgaccctggaaggacgagctggtgcactgtgtgctatcaagagctttgtttcccactgtggtgatcttcttactgaggaagtaactcagcgtcttcttccaccacttccttgtgctgtggatttgctaactcagctttcttcaatactaaaaatgtatggaagtcctttgaaaacaccgtcagtggtttatagacaaagactttatgaactgttgattttattacctcctgagacctatgaaggaaacctctgtgctatcctcagagagctggctgctgacttgactgcccctgatattcaggtggcagcatctacatttttacttccacccctctgtcatcaggatgatcttttgatactaagtcctttcctacaagagactgaccatagatttattgaagaacagctcctgcttggtaatggtgttgcttgcggaagtcttgaatatgacccttattcgatttatgagaaagatgtagagggagattcagtgcctaagcccttacctccagcactatcagttattagttctgcatccaagctctttggggttgtatgcgctcatgtgggagaaactcaaaggcttcttatattggaacagcttttggacagtataaagcacacaaaaggagctcgtcagcaagtggttcagttacatgttgtttcttcagtttctagtttcttgaagtacgtggctggctccaagggatgtttaggtccagaagaaatgaaaagatttgccttaacattagttatgggagccctagaaagccccaaccccttgctgagatgtgcagctgcagagtcatgggctagattagcccaagtggtagatgatggagcttttactgctggattagctcaagttagctttgacaaattgaaatcagcaagggatgtggttaccagaacaggacactcattggccttggggtccctacataggtatttaggaggaataagttcttctcaacacctaaattcttgtattggaatcctttatactttggcgcaggacagcacttctcctgatgtgcagacctgggcattacattctctatcattgatcattgattctgctggcccactctattatgtgcatgtggaacctaccctttctcttattataatgttgttgttaaatgtgcctcctactcatgctgaagttcaccaaagccttggtcgctgtttgaatgcccttattaccacgttaggtccagagctacaaggtaacagtacttcaatttctaccttaaggacttcctgtctactgggttgtgcagtaatgcaagataacccagactgccttgttcaagctcaggccatctcttgccttcagcagcttcatatgtttgctccacgacatgtcaacttgtctagcctggttagctgcctctgtgtgaatctttgtagcccctacttgttactgagaagagcagtactggcttgcttacgtcagcttgtacaaagagaagcagctgaagtttcagaacatgctgttatgcttgctaaggatagcagagaagagttgactccagatgctaacatcagagaagttggccttgagggggcattgttgatcttactagacaaggagacagatgagagattatgccatgatatcaaagagactttaaattatatgcttacatctatggcagtggaaaaactctccctgtggttaaagctttgtaaagatgtacttgctgcatcagctgattttacagctgtaacttgtgtggatacaatgcaagaagaagaaggagataaaggggatgatgcctcagtcctgaccaccagacgtgatgaaaaatcccatccttttaccaatccccgatgggctactagagtctttgctgctgaatgtgtctgtaggataattaaccaatgtgagaatgctaacagtgcacattttgacattgctttagcacaagaaatgaaaaaaagagattcaagaaatgactttttggtactgcatcttgctgacttaattcgcatggcttttatggctgccacagatcacagtgaccagctccgtctttctggccttgaaatgctgttagttgttattcggcgatttgcaactgttccagaaccagagtttccaggtcatgtgattctggaacagtatcaagccaatgtaggagcagcgcttagaccagccttcacttcagagacaccacctgatgtcactgccaaagcatgtcaggtttgcagtgcctggatagcaagtggagttgtaagtgaccttaatgatctccgaagagttcatcagttgcttgtttcatcgttaactaaaatacaggctggaaaagaagctctaagtcacttatataatgaaagtgcttctaccatggagatcttagctgtgcttaaagcctgggcagaggtctacataattgctgtgcaaagacataaaaaccacagacaacctttgaagactaccacctgtttagaagacggtatcagaaatggatcatgttcatcagatggactgcttgacttagtctatgcagatcttggcacactaagcagactctggcttgctgcacttcaggattttgctcttttaactttgccttcagaatttgcctcccaacttcctgctgaaggtggtgctttctacacagcagagactagtgaaaatgcaaaattgcattattacaactcctgggcacttatcctccatgctacagcattgtggcttacaagcacgggttttgttgttgctgacccagatgaaggagcatctaatctctccaggcctgtaacaccaacttccatgtgtcagggttcatcatctggggctaccataaagtcccctgaggatgtctacactgatagattccatcttattttaggaatcagcgtggaatttctatgttccttacgttcagatgcaaccatggaaagcataactgcttgtttacatgcattgcaagcacttctagatgtaccttggcccagatcaaaaattggcagtgatcaggacttgggtatagaattgctgaatgttctacatcgagtaattttaaccagagaatcaccttccattcagttggcttcacttgaagtggtaaggcagattatctgtgctgctcaagaacatgtgaaggaaaaaagacgaagtgcagaagttgatgatggggctgctgaaaaggaaactctgccagagtttggagagggaaaggacaccggaggacttgtgcctggaaagtctttggtctttgcaacactggaattgtgtgtatgcattctagttagacagctcccagaattaaaccctaaattgacaggtagcccaggagtaaaagctacgaagccacagatactattagaagatggaagtagattggtttcagctgcattggttatcctttccgaacttcctgcagtgtgctctcctgaaggaagcatctcaattctccctactatattgtacctcacaatcggggtcctcagagagactgctgtgaagttacctgggggccagttatcttcgacagttgcagcttccctacaggctctaaaaggaatattatcttctcccatggcccgggcagaaaagagccgtactgcttggactgaccttctccgaagtgccttaacaacaattcttgactgttgggatccagttgatgaaacacaccaagaacttgatgaagtcagtctacttactgctatcacagtgtttattttgtctaccagtccagaagtaactaccatcccatgccttcagaagcgctgtattgataaatttaaagctactcttgagataaaagatcctgtggtacaaatcaagacctaccagctcctacattccatctttcagtatccaaatccagctgtttcctacccatacatttactctttagcatcctgtatcatggaaaaactgcaggaaatagacaagagaaaacctgaaaacactgctgagcttgagatcttccaagaaggcataaaggtcttagaaacactggttactgttgctgaagaacaccatcgcgctcagctggtggcctgtcttttgcccatcctcatttccttccttttggatgaaaattctctgggatcagcaacttccataatgagaaatttacatgactttgctctacaaaatctcatgcaaattggacctcagtattcatctgtttttaaaagtttagtggcttcttctccagccctaaaagcccgccttgaggctgctataaagggcaatcaggaaagtgtcaaagtcaagataccaacatctaaatatactaagagtcctggaaaaaactcaagcatccaattaaagaccagtttcctctgattttttttttggaatagtaagcaccttaatataataaatacttgatcattgcctttggtgacaaaagggacattgtagacacaagtgcccttagaggtctagttgattgttttaccttaaatagctgtgactcttcaaagtaacagcatacttaacatttttgtgtgtgtgcgtggggtttgtgttttgttttgttttgtttttctatttaaaaagacaatggagctaacttgccaggaattttaagaaagtgctaaagaactaaacttactaaacaatccactgctttaaaaatgaaatgaatttcttctaacagtccatacatatgtggtatacttaatactgtgacagatataaatatgactctagtgtaaattatctgcactaatattgtatcccaattgctgatttaaaattctgctttggcccggcacagtggctcatccctgtaattccagcactttggaaggccaaggcgggcggatcacgaggtcgggagtttgagaccagcctgaccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatctaaaaaaaaaaaaaaaaaattctgccttattcagtaattgtattaaactttctctgatttctccaagaagataaaatgattggagagctatttaggaaacctggtctaggattatccagtatacaatagtacaaattacttacagccttacagtgcaacataagatttggtgtctatatcatggttttccaccatcttttggtttagtttatattgggttcagaaattgagtcttactcattttaaatagaataagccatttccactatttttcaaatggatttttctgtttacctctgttcttaccaattttgttcattttcatttgtggcaaacatttgtatcaatgagttttaacctaggttcatatctacattgtatttagatcaactatgggtttatataaatgccaaatttagtacaacaaatttaggtcatcaggtgaatacaagtattttttttaacaggaaacattttattatagaaaaaagattaatgataaagtcatattggttgaaaaatattttttaactgtgttcatgattgttgattctccttctacttcagtgttatactgtgtgaatcaagcactgtgtcaaaacagagcatttccctcttaaaaattacaaaccgaagtgatagaagcatgtcagaattgagaagacattttgaagcaagaacaatgtgatgtacctattttattatgtttgtatataaatactattgtaaattgttcagagtgaaaacatttgacaaactctaacactacaatcattttttctaaattacataaataaagctaattttcattatcaaaaaaaaaaaaaaaaaaaaaaaaaaaaaaaaaaagaagaaaaaaaaaaaaaaaaagaagaggaagaggaaaggaggggagggtgaagcttcgccgtttggttcgggcgcttctcgttcttgtttcgctgttcgctctctatgttcgtcgtttgtcttcgtggctgtcgtctgtttctctgcgtcctttgtcttgtgtgcttctcgtgccgggtcccgtggtgctgttgcttgttgcctttccctctggtcgtgttctgttgctttctgtccttcttccgctgctgtgctctcgtcgttcttgtcttcttcgcttttgtgttccctcggctgcggtggtctttcccgctttctctgtgcttctgtcttgctctctcccgatgcgcgcgtgggcctgcttggctttccgccttgtcgacgggtcgtgtcc

SEQ ID NO: 461211 - DNA, 1413 bp, Homo sapiens
ctgtcacagcccagaggagcccagtgagacatgtggagtgcaatggcacgatctcggctcaccacaacctctgcctcctgggttcaagcaattctcctgcctcagcctccgggtagctgggattacaggtgtgagcaccatgcaccacaactcctggctaatattgtatttttagtagagacggggtttctccatgttggccaggctggtctcaaactcctgatctcaggtgatccacccggctcagcctcccaaagtgctgcgatgacaggcacgagccgccaccgtgcccagccctttttttttttttttttttttgagacaaggtctcgctctgtcacccaggctggagtgcagcggcacaatcacagctcactgcagcctcaacttccctgggctcaggtgattgtcccacctcaggctcccaagtagctgggactacagatttatgatgtcaataaagcccattatgatcacaccctgctgttgaaaaatgggatggcagggaactgacaggctgtttttaggtcaccgtcttacacaataccaaccgcccatcaggttgtttcaaaggctttcagccactgactaatagaaaaagagactgcatacaacgtttcattcatgttttgctaggctagatacatttgttgtagcggtctcatatttgtaagtccgtggaaaaacctgaaagtatttttttcttgaaaatttttttgaaaaaaaagtaaaatgtcattaggagtgagaatcaggaatgatggattcacggtctagttgcaagactcatcacaggccattaacctctgaaaagcctttatctgcttcgctttgttacatatcagacgcggatattacttacgagtattgaatgatcccctcagtaaacaccagctatgcaggaggtgctaccttagcaataggagcttcagtctgggaggagagtgggacatataagcaaataaatacatcacgtttcccacagggcgcgtattttgtgttcatcttcgtcccactggatctgtccaaacttttcatttttgacagataaggaaaatgaagttcagatgcttgagtgacacagctaattagtggcaaggctgagacttttgaccagacagcctgacttttagtttctaccatgcatgttaactcctcctaaaccccatttattttctcatttcagacaactgcgcaataacactgctaagataaaagcactctgattaataaacactgaaattaagcaggttaagaaatatctattgtccttttctcagagtgataattttaaaaactgaaattggtcttttgcactcgcagttttctcttgcttccttaaacatttgcgaaatatgagaacaatataaataggttctcaagctctgagcaaacccttaaccatgtaaataa

SEQ ID NO: 461212 - DNA, 1418 bp, Homo sapiens
gcatggaaaataaccacgattcagacagagctggcacttaaccactcatacaagctcaggcaagctacccagtgtgccaaacctcagtttcctcatcagaaaaaatggaggggtccatacagcgtcgttctggattcccgtcgtaacttaaagggaaactttcacaatgtctggagcgcttgatgtcctgcaaatgaaggaggaggatgtccttaagttccttgtagcaggaacccacttaggtggcaccaatcttgacttccagatggaacagtacatctataaaaggaaaagtgatggcatctatatcataaatctgaagaggacctgggagaagcttctgctggcagctcgtgctattattgctattgaaaaccctgctgatgtcagtgttatatcctccaggaatactggccagagggctgtgctgaagtttgctgctgccactgaagccactccaattgctggtcacttcactcctggaaccttcactaaccagatccaggcagacttctgggagccaaggcttcttgtggttactgaccccagggctgaccaccagcctctcacggaggcatcttatgttaacctacctaccattgctctgtgtaacacagattctcctctgcgctatgtggacattgccattccatgcaacaaccagggagctcgctcagtgggtttgatgtggtggacgctggctcgggaagttctgcgcatgcgtggcaccatttctcgtgaacacctatgggaggtcatgcctgatctctacttctacagagatcctgaagagattgaaaaagaagagcaggctgctactgaaaaggcagtgaccaaggaggaatttcagggtgaatggactgctccagctcctgagttcactgctactaagcctgaggttgcagactggtctgaaggtgtacaggtgccctctgtgcctattcagtagttccctactgaagacaggagtgctcagcctgccatggaagactggtctgcagctcccactgctcaggccactgaatgggtaggagcaaccactgactggtcttaagctgttcttgcataggctcttaagcaacacggaaaaatgattggcggaaaataaacatcagtttcttaaaaaaaaaaaaaaaagaaaagaaaagataacaatgtccttctttgcaaggcttctgtgaattcagtcctttctcccagtttcacaggcaaataaggacagggactcagttgaggtgactaatcctcggagccacagccccccaattccaggggcttggaaatgctgggatcacaattaaaggctttgaacttccaccagacaccaccaccagagctcactccatccgcaaatgctatgtacattcttggccacaaaaacacttccaggacaaaaaaatgtttcagagttcagaact

SEQ ID NO: 461213 - DNA, 1002 bp, Homo sapiens
gactagcattggaatcactgtagaacacatagatttggcgtgagatggcttcattgtgaacgagttcccgtttattgtgtcaaagtcaagccattgagcagccaggtacggatgggccaactgccgagccacggtggagaaggtggagaagagcgatggagttctcagcgaaatcagagctgcctcggtggatggagctgaattcctgaggaaaagctcaactcagttatggacggatcttgttcctccctatcaggggatccccaaggagaacgcttggcgtgtcctcctttggtccagcctgggttgcagcttcgatgctccctctgtgcaggggggaaggtacctgcagattgcccatctgtaccccaggatttaggggacacctgatgaggtatttgtgtttaatcatcatcttgatgcggacgcttttaggaacaaggactgagactgggagggattataaataaacactcaaatgacaggaaatcttcagcttggccgccatgccggagtcctctgagagccaagacctacccccagcccaggccagcgtgctcggcacaagccatgcccccaactcacccacggtcttccctggactccctgcccccgccctgggagaccaccagtgggatggggtatggcaggaccagccctgctcagggaggggccgccccctaccaacatgggcccagccctgggaccagaatgaacctgagcacagttcacatctgagacgcgtccccgggacgggggctgcggtccatggtttggcaaggggccggggctacagagggaatggcttccggtacagagccttggacacaagcctggtgttgtgtgttttctcagatgcggcatttgtccatttggcatccattaatcacagggccgaactaacagctacattgtttctatcttccctgccctccagaacctgcctctgaaccacctccttatctaactctcacaccacaagctcatgtcccctgccctcag

SEQ ID NO: 461214 - DNA, 2261 bp, Homo sapiens
ccaggtagtttgggaaagaaacaaactcttctgcctttgagactaccctcaattaattgtgagctcgtgaaggatggtacgtgatgctcttgtttcccttgccgataggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggaaataccagggagaagaatgtcattcttggatggggcagtggcagtacaaggcttgccaggcagggccagacctggggttatgcaggcatctgggcttggctggaggggtcacatctacatgatggccaaccaagccatgggttggtccacggaggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaagaaatgataaagataccactgtcaatgattgatactactcactacatgttgtcatgtttattagtagtactaaagccacagtataaaaacgacattgaaatagaaggacctcgaaccaggcactccttttggaacatagaaggctgagaaggctatagatctttctgaaagatcaattcattcctgttcaaattccgcctggccaggagtggtacctgctgaatcctggggttatgtttcctgagtccctccttctcacttgtgtattttgctgcaggagataagctgttttcctgggctcagagtgtgtccctgatctaattgtgccctctttgtcccaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctcattgtcttatttattttctcagggcagcaagggagagaaatggaacaaatcaggaaaccagcctgctagtttagtgagtagcatttcaccctacccagccacgggaattgggaatagcaagggagcaggcctaggcctagaactcagggcaaagacagcagctggaatgtaa

SEQ ID NO: 461215 - DNA, 481 bp, Homo sapiens
cttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaatagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatct

SEQ ID NO: 461216 - DNA, 1144 bp, Homo sapiens
aatccagcatacaacgacttgagaagaaatcatgatgtttaacagcatccctggctcctacatactagatggccagcagccacccccgcccccaccaccatcagtcatgacaatccagacaaggccaaatgttccctgcaaggaaatattttccccagtggacaacaactggcctaatgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaatagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatct

SEQ ID NO: 461217 - DNA, 1437 bp, Homo sapiens
ctacttgcccagttcccgaagcgaagcgcaggctgcgagccagccgggccgagtccacaactttgcagcctcgggcagggcgagagccggcgtccggggctcctcttgtcggcgaccagagctcggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccgtgccaggaaaaaaccctgtgggaaatggcttccatccacccaggcttgttcctggggcagtgttgcaaggcaggcccaagcttgacagctctgatgttctcacatcccagcttgagggccacctttgcctgtcagcattcctcacgccaaagagcaccatggacctgggatcctccatcccccacatggctgcccaagctaatctgtgccgacatggaagaaaggaggtgatagggttgccctacagggaaccaaaggctaaggaatactttcgaattaactccagggtccagtgccctggctgctgggtaggtcaaggagctgtcctgggttctgaaatgttcgtcatcctcatgctctacctctggttcgccatcggcctggcctgcgccggcttctgctgccaccagctgctgttgatcctccgcgggcagacccgccaccaggtgcggaagggggtggcagtgagggcccggccctggcgcaagaacttacaagaggtcttcggaaagaggtggctgctgggcctgctggtccccatgttcaatgtcggaagtgagagctccaagcagcaggataagtaaagacaggtgaggaaaagagtgaagagagtccctctgctgctcctccacagacagagccagcttctcctagggatcagtcaggccccctgccctctcaggccctgcaacatctggaggtctcaggcttcccagccctggggacagttgggagggtgttgagcctttcaggcagtgggccctgagcagac

SEQ ID NO: 461218 - DNA, 1564 bp, Homo sapiens
ggggtgaggctcaaagaagaagctccaagttcaagctctgtgtctggataaactcccattgtctttccttctctcaaatcagagctgcccgtgggtcccagggtgatgctgggctgtgtagaggctgagtgcaggagcattaatgctagaaccagatgaggaaactggaatctaagatcacactggaatttacagacgaagaaactggaatctgagatctcacagtagtgaatggtgaatattcaaacccaggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccgtgccaggaaaaaaccctgtgggaaatggcttccatccacccaggcttgttcctggggcagtgttgcaaggcaggcccaagcttgacagctctgatgttctcacatcccagcttgagggccacctttgcctgtcagcattcctcacgccaaagagcaccatggacctgggatcctccatcccccacatggctgcccaagctaatctgtgccgacatggaagaaaggaggtgatagggttgccctacagggaaccaaaggctaaggaatactttcgaattaactccagggtccagtgccctggctgctgggtaggtcaaggagctgtcctgggttctgaaatgttcgtcatcctcatgctctacctctggttcgccatcggcctggcctgcgccggcttctgctgccaccagctgctgttgatcctccgcgggcagacccgccaccaggtgcggaagggggtggcagtgagggcccggccctggcgcaagaacttacaagaggtcttcggaaagaggtggctgctgggcctgctggtccccatgttcaatgtcggaagtgagagctccaagcagcaggataagtaaagacaggtgaggaaaagagtgaagagagtccctctgctgctcctccacagacagagccagcttctcctagggatcagtcaggccccctgccctctcaggccctgcaacatctggaggtctcaggcttcccagccctggggacagttgggagggtgttgagcctttcaggcagtgggccctgagcagac

SEQ ID NO: 461219 - DNA, 577 bp, Homo sapiens
ggggctggggggtgcccagctgccatccccgccgcttcctggcccttactcgctggcgcccaagtgggaagccagcagctgcccgctccctcctccccacatccccgctacttgcccagttcccgaagcgaagcgcaggctgcgagccagccgggccgagtccacaactttgcagcctcgggcagggcgagagccggcgtccggggctcctcttgtcggcgaccagagctcggtgagttgatttcctcacccctctgcgacggcggcagtgcggcggcggcggcgcggggggcggcttcccgtgcgtccgggaggcagtggccgagaagcccgcggctgccggcgctgccggtctttccaaggctccggctgtgccgccctctgccgcgggcgaggcgggcgccagggctgaacggacagctccctacaccccggggccccacgggcggtctctgctgtcccttctcccgcgcagggccagggctgaggctgcctgccgagcgcccctcactcccctagcccctgtccttcgccgccttcccagcgctgcggcgcatctggctgctcccgcgccccc

SEQ ID NO: 461220 - DNA, 1833 bp, Homo sapiens
agggcggtgaccccaactggatggtcagacccagtgtggcctctgccgtgggggttcagctgcgtgtttctcggtctggaggccccagcagggcctacgcaagctgtggggaggaggctcccctgctggggattctttgacagggtgttgggtgtcagaggcccagggccagagcaccaggggccccagtgggaggagccaggtgtagggatgccaccaaccagcccagcagcaactgcaggaggcccgcggagcctaaataacccctgtattaaaatcacagtgaccagacacacatgccctggctgggggatcacacatgcgaacctgcagacaattccagatacccaaggccaggaaggcccacgtgaggatgtcactcaccctggaggagacttggatggggtggcaaatttctatttggaggaagagggtttccaggatggcagatgccagaagatggtcctgatgtctgaggaagggccacctagtttgacaggatgccctcgagtgcaatgtccacaaagcaacaagttcaaactttccaagtcgatgcaaagaatcctgagacgggtgcatgagaacagtagacctgcagttgggggattgcagatgccatgaggaattgcagacttttgtccattggattcttgagatgtgtaaggttccttttgtatgtggggctctacatggtatatgagaaaaggcccagtgttcaccggaagaaggggagatgggaactattcccagccactcttctctcaagaactgatggggagtcatgggtccctgccccacttgtccatgtgagagggaagcaggtgtgcttttaccagaaagagttctcgaggggttagcaccccaggaatgcatctatgctgactctgcttatcatgactccccaccttcaaaatacatcttagggtcaccgcacatcccagaaagtggcaacacaggggcacccctcgatgtgccgagtatccagagtcacgttcttggaaggcgtgaccagcgtgtaatttaagcaaatggaatctttcccaaatgtcttcttttacaactgaaaaaacaaattaagcaacagaggaaaaacaaatccagagaaatagcctcttccggggaagtctgacctccctgtctagaagagaatgtggaaaatacagaaaagtataagcagaagcataaaaattattcacagttgcacccttggagggagctgtcctataaatcttggtgaatttgctgcccttcttttttctgtggatctgtctattacatgtgatagtttttaaagctgatgtcatgttattgatgtagttttgcttcttgctttatccattgaagactataatgtgagaaatttcctcgctggggctcttcccaaacctgatatttactgaccacaccaatattcaattgaatgagggagtgtcataattcaatcacttatagtttccagaaacgttgtgctcatttacattttccttagcagcatatgagggtgcatgaatcccatcatcacaacgcaatggaattagggagaaatgccagtgaaagatgaagagagatgaggcaggactagcaggagcgcctcagaccctcatttctgcaggcaagaaaggaaaggatcctgtggaagggtctcccactgctgtgtgattctaaaagctttgggcaggggatagggagtctccaaaccaaagcctggtggccattctgtgacaggcaggagtgggctgctatgaggaccctggtcatgttgaagctttggcggggggtcaccaagaggtggatagctggagctgtcagtcaactctgcttcccaggggcaga

SEQ ID NO: 461221 - DNA, 918 bp, Homo sapiens
tgcaaccaggattgggaaccagttgtcaggaggaatggagttttctgagggagacagaatcaacttggcattccctggtggaacattctgccctgcagaaagagaatgtggacatgaacgagctcctaagggaaaggaagaaagaaggcaggagaaatcttggggagggactgttttggggcaagctttcaagcctgtctttgcactgaactgtgggcagtcaggtctctgtgggctgccagcttcagtagactgcttggagtgtggatttattggagaggagtcctccccaactttagcagactttggaagcgacccctcaggccttgccttgcaggttctatttggtggcaggcaagactcagcagcctgtagtaaatgcagtcaggcctcaggccatgatgagtggcttcttcgctgtgccttcttattggctccagggaggcgaggctgctcctgggttagtgcgtggtggggtgatgacactggaatatactgtgttttaaacaaatgtgcgttttgttgggtccggccatctctgtaaacttcagactgttttgcaccgtctacaaacggggtttaaaatgagctagcgccatctactgggcgaatgccgtaaggtcggttgtgaggtcccggaatctgcaaaggaatgaatgaattacaaatctgtggctttatggggggaatgtcgagaatcgggcacacgctgaagtgtgagaaccactgccattatggagaagaggcttcccgccccctcacctgccactctagaaatccagagaagagattccacttggattaagacttgcataagtggggagttgagtccagtctctttcccccactgcaataccctgttgcggtgacatgtaataataataaaaagacttgcatgaactcctttctgtgcaaatg

SEQ ID NO: 461222 - DNA, 2828 bp, Homo sapiens
cggcgccaacatgggtctgagtaacaaaagacgcctgtccagggggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgagccccgcgcccgccccgccagtggcgccttcccacctaccctgtgcgcggcagggctgcggggccgggcggagaacgggaattttgttccgcgcaggcgtgggagcagcaggcctcggccactctccgcaggcccagccttgggcgcgctgcgaaaccgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaactcgcagttttccgagtctcttcgcactcccgccttgggaaccacagggttcgttgctgggaagctgtctcgggaccgcgtgcggagcgggaggggggc

SEQ ID NO: 461223 - DNA, 2863 bp, Homo sapiens
cggagagccggcggatccggactccgccgccgctctccgcggcacctgcggcacgtcgccggctccaggcgccgcgcactgagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgagccccgcgcccgccccgccagtggcgccttcccacctaccctgtgcgcggcagggctgcggggccgggcggagaacgggaattttgttccgcgcaggcgtgggagcagcaggcctcggccactctccgcaggcccagccttgggcgcgctgcgaaaccgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaactcgcagttttccgagtctcttcgcactcccgccttgggaaccacagggttcgttgctgggaagctgtctcgggaccgcgtgcggagcgggaggggggc

SEQ ID NO: 461224 - DNA, 764 bp, Homo sapiens
  misc_feature (694)..(694): n is a, c, g, or t
cactcgctgctgaccaggctctgccggctccttcggcctcgccgcaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggngtggtggtgtctacaggctctggtggtccccacttttcctcgggaggccttgtgggcccatgtgcccccg

SEQ ID NO: 461225 - DNA, 1807 bp, Homo sapiens
catcgctaggtacgaggctgggtgagcttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461226 - DNA, 1763 bp, Homo sapiens
gggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461227 - DNA, 1890 bp, Homo sapiens
catcgctaggtacgaggctgggtgagcttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461228 - DNA, 1728 bp, Homo sapiens
aacggctaggtacgaggctgggtgttgaatcggccgaggctgaaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461229 - DNA, 1542 bp, Homo sapiens
ggacgcgtgggtcgacccacgcgtccgcggacgcgtgggctgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461230 - DNA, 1294 bp, Homo sapiens
gtcgactctacagatcctccgctggccaatggcaggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461231 - DNA, 334 bp, Homo sapiens
tatacttagagtcgaggcgtaccccgctggccaatggcagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgtgggccagcgggcctgttggcccagtctggattgggtgcaagaaggggttggtgccattgggccc

SEQ ID NO: 461232 - DNA, 1533 bp, Homo sapiens
catcgctaggtacgaggctgggtgagcttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggaatcgaatttccgcggccgcatggggcgggagcatgcgacgtcg

SEQ ID NO: 461233 - DNA, 1793 bp, Homo sapiens
gggagattagagaaggagccaggagggtggcagggaggccacgtgatccgagtcccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461234 - DNA, 1680 bp, Homo sapiens
cactcgctgctgaccaggctctgccggctccttcggcctcgccgcaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461235 - DNA, 1499 bp, Homo sapiens
cacccaggcgcacttctgcacccaggcgcacttctgcacccaggcgcacttctgcacccaggcgcacttctgcacccaggcgcacttctgcacccaggcgcacttctggtagagtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461236 - DNA, 1125 bp, Homo sapiens
tatacttagagtcgaggcgtaccccgctggccaatggcagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggagatggaattagagagggcttcttagtctcctttgggctgtggaatcccataaaaaccttgaattgtttccaatacccccttggtaatgcagatacagaagttaagctgtagagctcaggctccaggtgaagaactgtgtctctgtagctgctgctttccatgaagctagaatgagcgtgccatgccattactttgagcctttccccaatgacccaggctggggtgtacagtaactacatcagctctctggacctagagaatct

SEQ ID NO: 461237 - DNA, 625 bp, Homo sapiens
gaattcggcacgaggatttttttcataatttactttttctctggagcatagattcaaaatgccctgaatatatgctctctacttcattcttttaataactatacagtttgctaatgttacactggagtatcccagtgcttaaaaatataatacacttggctgggtgcagtggctcacgcccgtaatcccagcactttggtaggccaaggtaggaaggcagccttatccccaggagatgattgaaaatgtaagaactattctgagcctgcaggccatagccaaagaggacctactgttaagttttcaagaccacccagaaagaaatttgaagttgggtttatatccttaatccctcagttagaaaaaaaagaaaagtgaagaaactgcatctccaagatcctgctatatcaacttcagttttttgaagttaaatttgatttttaaatcccttggctgatgagacctgtgtgggtttttttttgttgtttttttgttttgttttgttttgttttatcattgtacctctattttaaaaatagagacttgtggttctttttccaaaagcagtccaacagaaagtgaatggtggtcaatgcataataaaatgagagttaccttttgactt

SEQ ID NO: 461238 - DNA, 1066 bp, Homo sapiens
cacaccgaatccactgaacagatctctttgggttttggaataacaaaaaagggactgtacatggatatttccaagctggaaccgaggcactttctagacgaaggcagccttatccccaggagatgattgaaaatgtaagaactattctgagcctgcaggccatagccaaagaggtaccggctgtattttgtccatgggcaggagcttgtgactgctggtctaggtcattccaggtcaaccaggggcctctcccagagtgagaaccactggtgattccccagagtgggaccaagtgaaagcacttggctggatcagagggataggagcctggctgctcctaaaacaagacactacttgcctttgatgttcaagtcatttaagaacgcaattgcttcctactcaatttttcaaaaccaaaataacaaatacgatatgagccataacttagcaaaattacgtgttttaaacagtctctttcaaaaaacaatagattaaaaagtgcaatatttttaccccctcttaaattggaatcatgacaccactggataagaaatttgagggagtaccccgaataaacaaacattcacaatcattcacaatcattcagcattacctcccattctacagggggataatccattttaaattaattctgaattcatcaaaatacagttcacagaataattatactggtaatgattcaggagacactttaaaagagtattatagctttattgtgatatatatagttcaaatacattttgcccatttaaaacgtacaatgtttggtaagtttcagtacaatcgcagatatatgcaaaccgtcaccacagtcgagagaagtcaagataaaacaagagaacaggaagagaaagaaaaacaaagagaaggagagaaggaaaagagaagagatttggaggtacatattccagggtgagttcttggggtctttattgttttaggacttctcagtattcgtcgtggtaacagagctttatctgcctggttgccaaataatgtcttcccaaataatatgagagagaaagcaaaagagaactgttcattc

SEQ ID NO: 461239 - DNA, 1714 bp, Homo sapiens
  misc_feature (8)..(9): n is a, c, g, or t
  misc_feature (18)..(18): n is a, c, g, or t
gtgccacnncactccagnctgggtgacagaaacggcaaaaatccaaaacactgacaataccaaatgccggcaagaatatggagcaagaactctcattccttgatgtgctgctgccgaccgggcacggcgctgggcctgcatttgcgctttcctggagcctcagtgtctcatctgtacaacgttgataatcgtcggcagcacctctttcccagggttgctctgaagggttttctttggggtgaaccgccaggcggtcggcctcccaggagcggggggagacgccttccttacgcgacgcacttccgtgcgcgaggagggaagatcgtggctgagtgcgggtggcctgggcggaaggctcagcggggacagccacggcgccaagcaagctggacgtgcgtgcatgagcgcgctcggactgacagggaagcgaaaagggggccagggcgcaccatagaaaagccgcggcagaaacgtacgacacagcccgaggcggcgggggcgagagctccggggcagggacggcgacgcggcgtacccggtttggcgcccctgcgcggcggtcggccgtcccgcagcgccccaggtggccgccggcggggtcgccgccgggggagtggatttgctccgcctccgccgggctcggctgccctcggcagcttccccgcctggctctccctcgaccctcctcccctccccctcccggttcgcgatggactgggcctccccgccgcgccgccgccgccgtcgcccgcagcaccgcgcgggcctctgagttgcagggcctgaggagccgcgtgctggggactggacgtccgctggctgctgccgcacgcgagaacctctcgcttccctgtcaccaggtcctcgcggaggaaggggagggacgaggcgcggcttttcctgtgccgcctgcccggttcgacctgcgcggcctgcggcttcttgggaactctagggccgcggccgggcctggctctgccggcggcctgttgggagctggatcggagcggtttggaacgacaagcccgacaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacgctttattcatatatagtatgatgtaatttttaagagactggggcctcactatgttgcccagtctggcctcgagctcctgggttcaagcgattctcctgcctcggcctcttcagtagctgggactataggctgtgccaccacacctggctttataatgtaattttaaggaaatgaacctaaagttaagtcagatatgatttactatatgaagatacaagagtatttcaagttgaaggggttagccgtgtttggggtagtgtaccagtaacctccaaaaactagacatttggtttaattttgtgactgttttgtttttaaacattagtttgcttttcattctatagccagattttcttgttgttacaagggaaaattgtcctggttccttcttgaaactagtgagggaggcatagagagagttacaatggataagaagaaataaaatataaattctaaagagaaaaaaacaggtctgtttggggtagttagggaatgtagtctaaaagtctaggaggtgacattt

SEQ ID NO: 461240 - DNA, 1891 bp, Homo sapiens
cggacgcccggcgagtggcggaaagcgagaccccggcgccgagtgaggtcggccaggctgctgccgacttccccgctggcccctttgttcccctcccggggccctgccggcggcgggtcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgatataagctacatttgaagaataccacagcagtggtttaacatttttgaattgactagtcagaatgggctttgggaccggctcgatca

SEQ ID NO: 461241 - DNA, 817 bp, Homo sapiens
cggacgcccggcgagtggcggaaagcgagaccccggcgccgagtgaggtcggccaggctgctgccgacttccccgctggcccctttgttcccctcccggggccctgccggcggcgggtcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtaagtattacttattggctcattacttatttttctcagacctctcagggatgagtattggctcatttaaacatcacttagagactgaaaaatgtatttactaaaaaaaaaaaatttct

SEQ ID NO: 461242 - DNA, 433 bp, Homo sapiens
gaaagttgaaaaactgcattaagcactcttacgtccaaacgtacttaggagtcttttttaattgctaggaggacactatgaaaatttggttctagcagatgtaaaggaagaaaaatttaagcccaagctgttcagtcccggaatttaaaggacttttctccctttacttttcaaatttaagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacgtaagtacattccttcatcatgttcctttgggttactgtagtgacatctgttttcaaccatttgctgacttcagtttgtgtagaaatttct

SEQ ID NO: 461243 - DNA, 1589 bp, Homo sapiens
cggacgcccggcgagtggcggaaagcgagaccccggcgccgagtgaggtcggccaggctgctgccgacttccccgctggcccctttgttcccctcccggggccctgccggcggcgggtcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggaggtcagaaaatatttttttaaatataaaaagaaagttgtgagataaccatataggcagtttctagttttcggacagtactcttagaaatccagataacaaagtggcacccc

SEQ ID NO: 461244 - DNA, 9402 bp, Homo sapiens
gcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacaggcaaatatgcagctgcggcattatgagatgcagcagcaacagtttcaacatctttaccaagaatgggagcgagagtttcagctatgggaggaacaactccattcctatcctcataaagatcagcttcaggagtatgagaagcagtggaaaacatggcagggacatatgaaagccactcagagctatctccaggagaaagtcaattcatttcagaacatgaagaaccagtatatggggaacatgtcaatgccacctccttttgttccatattctcagatgcctccacctctacctacaatgccccctccagtgttgcctccttcattgccaccaccagtgatgccccctgccctccctgctacagtgccaccacctggcatgcccccacctgttatgccaccttctctaccaacctctgttcccccaccagggatgcctccttctctctcttctgcagggccaccaccagttctccccccaccttccctgtcttctgcagggccaccaccagttcttcccccaccatctctctcttcaacagcacctccacctgtcatgcccctcccaccattgtcttcagctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcagtcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgagatggctgatcactgggaaactgcacctcgtcacatgatgcgtctagatattcgttctttgctgcaagatgctgctattgaagaggaagatcactctggcagcatgaatctggagcgggtgagtacagacaggaagactaggtagagattagtgctttgctttcaggtgaaaaaaaaatgaggtcagtgaattattaaataaaaaggaatggcagaggagaaagagaggacaggattgagctgaactgttcaggagctggaatggttaggacttggattgtccagagagttttctctttgtgacttaaaatatatggcttttcccagttttcctgggttagtttttaattttttaaacttgcggtttcaaatgagtcattctaccccttagactgtccagagagggagggggctctttgcatatttatttttcctaaagctcagcctaatgctatgttctttttaggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaacctttttttcattgaatattatatggctcaatgattccgtagcacatgttgtaaaacacagggttcaaatgatgttcaaaacactcatctttgttttatagctgatttctctatctttgtgtcttgaagactgaccaagttcaaatattcatcagttccctggagcatatccattctgtaacatgatgctttatttaaaaattttttttgatcctctctctgttcttccctctcttctttccttccttcttcttttcactttctgcctttatgctgttaggtttttattttttcctgatctggctttgaattctggtagacagaactgatgtattctgtggaactcaagcttgttgccttcatttgaacttgaattgtggatttttaaatgaagattgcagggaaagagtataaagatgcagagcactctggcatgtaacctttaagcctgtcaggttttcaagttcttgccagattgttcattactggaaagcatggccttctgcacagaatttcctctcttgtggttaataccaggtggaacccagaaacatacagagataaaacccaaatattatttctatgtaaacacagaaaagggactcttccctttttcatcctgcaaagaaaaaagtcatcttttagcatgaaagaagatgagagagccttcttcctcaagcataatttgcattttgtaatccaactcagtaatttgtaaatgtgttcactgaagacttcaatattttgaaatattctctttcaggccacagatgaaaatcctttacttttatgacctacattaaagactgtatgaatagagctaatagttactagcatttgaatagtatcactttgggttcaacaaattgatattatagtactgaatacccctaatttaatggaaattctaacaactttctgtacttttatcttccctgaaaatctgaatttttaagcaagtgactttaagttcattaagtcaatattgaatgtataaattgctacattaaataacttctgctgtttgtagtatttaataagctattttcattgcttattggcctacaatacatttctgtgtactgacctttctcagcagcctttattatgtagagtgaagatatgtcgcaaaaatagccaaatagaattattgtttgtacaaagactcatttactactttctaaagccacccaatgcctattatcaaaaacaaaacttccataatgtgttctctagttcagatgaaatggaggccgatatgttcttctgcaggatgctttatttcagttgtccttaaccttgtgatgttctgacagtagttagaatgccaatgaaatgagtggtgattatccgtgagtcacttggaatcatgggtaattttgcatatgtgtgttttcaccttacagccatggctttatgtctgtgctcttataccagggcagggtgggaagctggggaagagttaacatagtcagaaacggcctctgccaattttcagaagatatagattacgtgaccttagagaatgaacatagagtgctcctactttagaaaatgggtataacaaccttcatgcaaggagattaatgaaaaaagatttggcaccaaaaagagtaatagagacagccagctgataattgattttgctagtccaatgtgggacttaacaaaattcttgcacttacattactattagaagcagtatcgtataggaagcccaaggtatcttgaagaagaaatttggtgtgggtagaaaatgccttgataatacaaatattttaagtttgttaagaggtgtcctggaaatgcagaggactaattttggattccattatttgctagcattttattttaattttattaacattgtcttctcttagaaagttgctggtttaaatcatatgagttttattttaaatcttttgtggtgtcatgttacttaaaataatcttatgttgggaaaggtttctgataccttggtgggtatttcagctttttttttttttttgtcagctctgtaaaggatgatttcagacattttaaactgaaagtgaaatctctcacttaagtgatctaactttacttgtaaacttcctgtgtgaggaattcagtagacgagacccagaaatgtttctgtttgagaatatttagagttaagtgccgtatttgaaatattcagggactgattgtagaatcagaagtcattaataataatacacaagtagtctattgacagttgattcatataattttctagaagtttgagtttgattcagatatcagtgttaaatccagaagtttattgacaaagataaaatcttaaattttctggttggatttgttttcctcgtgaaag

SEQ ID NO: 461245 - DNA, 1428 bp, Homo sapiens
gcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggccccctcctcctcgggcttcatgagcttccgcgaacagcacttggcgcagctccagcagctgcagcagatgcaccagaagcaaatgcagtgcgtgcttcagccccaccaccttcctccgccccctctgccgcccccgccagtgatgccggggggcggctacggagactggcagccgccaccgccaccgatgcccccgccacccgggccggccctcagctatcagaagcagcagcagtacaaacaccagatgctccaccaccaacgagacgggcctcctggtttggttccaatggagctggaatccccccctgaatctccccctgtgccgcctgggtcctatatgcccccatctcagtcttacatgcccccacctcagccgccaccctcttactaccccccgacctcatctcagccctacctgcctcctgctcagccgtccccttcgcagtccccaccttcccaatcctacctggcgcccaccccttcttactcatcctcctcctcttcctcgcaatcctatttgagccattcccagtcctacttgccctcttctcaggcatctccttcccgcccctcccagggccattctaaatcccaactactagctccaccaccaccgtccgccccccctggaaataagacaactgtccagcaagagcctttggagagtggggccaaaaacaagagtactgaacagcagcaagccgcccctgagccagatccctctacgatgactccacaggaacagcagcagtattggtatcgacagcacttgcttagtttgcaacagaggacaaaagttcatttgccaggacacaaaaagggtcctgtggtagcaaaggatacaccagagccggtaaaagaagaagttacagtacctgccaccagtcaagttccagaatctccttcttctgaggagcccccattgccacctccaaatgaggaagtgccacctcctctcccacctgaggaaccccagtctgaggacccagaagaagatgccaggttaaagcagttgcaggctgcagcagcacactggcagcagcaccagcagcatcgagtcggtttccagtatcagggaataatgcagaagcacactcagttacagcagattctacaacagtatcagcagattatacagcccccaccacatatacaggcaatgtcagtagtgatgcaggagaggttccgggtccaggaggtagtgatactgatctacgcaggctcatcacgggtacacgcaccacact

SEQ ID NO: 461246 - DNA, 912 bp, Homo sapiens
  misc_feature (2)..(4): n is a, c, g, or t
  misc_feature (6)..(6): n is a, c, g, or t
gnnncncaggaagccgactgagcaaagactgcgtccaggccccgcccccatgagcccggccacgccccctggagcccagccccgcctcccggccgcccgcgcgcaggtagggaagaggcggagcgccgccgccccgcccccgaggagccaccgcccagccgctcgcaggcgccgcacggagttgcgtcccggggacttggggccgcagggaggtgagcgcggggcgacgagcggggcaggactcacggccgcccagccgcaggcgccggaagggtcccgaggttgtgcccgagcctgccctggagcggtggtgcgcggccaggaagggtgcccagtgcccggtgcccgccctgcggagcgcctgggtcccacgtgggctcggctggaggcccgggctggctcagacggcgccggcggggccgctggacccggtctgctggcccctagggctcggctcggacaggacgcctaaggggtccctgggcgacggggcgccagatgtaggggcaagacgattgggcagagatttaaacctccggaggaagagaggagactgcgcagggcagtcccgcctgcgtcccagaagtgcctgcagttcagacccttctctcccctccactttctcccggggcacggaacagcccacataacgaggaattatccagcccaaggtgttgggctgtgctgaggctgagaaaccctgcgcagcagctggtccatcaggttccttctcaatgatgctccctcactggggaaactacctcagttttccagagtggttaggggaggaacttggaataaacctgaatgagatgagggaatggaagagacgctaatgtcaccctggaaggtgttttgaagggtaatgtgtgtaaagggccaaacaaggccccgcacagttaaggacttaaa

SEQ ID NO: 461247 - DNA, 2445 bp, Homo sapiens
agccgtgctgtcatgagatggagctgctgagtgccctggtcctcgccctctgagagtggaagggtgggggtggcggcccgacgttcctggctgggagcccagaggagtcttttgtaatcacaacatgatctcgtgtgctgagcagcgaagccggcagggagaggccggcagaggcccggctccggtggctccagctttcctcccactctggctccccaggggctgctctggaattctctcggtgcccgccgttgccatgcactcggctgtgagtggcagtctgcctttggcagggggcttcttgggactgggagggggctgggataccaggcagccaccctctgggggcagctggggacagctggggctgggaggaagaaggctgtgactagggtcacaacagagaacctgcatccagacagagaggaacctggaatcttgatgcagagacatggcttgcccagggtgactcctgggctggggccgccaggggagctggctctctccgccccgactaccagcagctttcggcctggagaggctgggcccctgggagcggctctttcctccaggctgggcacaggcctaggtgcggggtccagggcctgagagcccaggacggagccagggcctctcctttttctctggttgtggatctgggagccaaacagctcccccctcgacctcccgaatcccctggcagcttcccagtcacggcaggttccgctgccagagccatttataactcccattccaggctctgctcggcagtgaagctccctggagagctgggggaggggcaccccactgctgggagctgtggcttggggtatgaggccctgacctgagccccctgaggaggcagggacaggcagacgggcctagctggaatgggggcttggggccttatttgggccatctccctaagcaatccccttccttcctgggtgaccttagctgtgggtctgggatctcttccttgggtggtgaaaatgtgaaagctggggactggtgagagggggacccggaagtcaggagcttgggttccctgcctctgcagggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgtaagcctcaccctgggagacagggctcgtagcaaggaggtggaggcccagaccattccacagccctgcgcctatgccacaaagcacaggccactcctaaacctcaagccccaggggctaaaaccctgcaggaagtgggggacagagaagttggggctgaatgccaggagcagtgaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgtgggtggctgggttgggcaggttgcctgtggtgcgggatggagctggcttcgggcactgctgggagggctgcagggaccctcctcggggttgagaggaccttgctgggcattctggtcgagcccagggttcaaggctctgggtctcccatctttcttgggcccaccatctccctgctgccttcaattctgggcctgggcttcggggaggggggtgtcagggtggggcccgcggcagcttctgtgcaccagcaacctgactccctctgtctacacaggctacaggactgcagccagctgaggggagaaggcccggccagggcaggcagcagaaggggtgagcccacacctacctcatccctcccctccttggctttgttcatctttcacccccttgtcctctcttttctctgtctcttagtctcttattttcagagctgaaaggaagcgttggagaacatcttccttcctctccctcactatcagaggagggcaccaagacctcccatcctcccctctgagcccacagctcttgtccagg

SEQ ID NO: 461248 - DNA, 1204 bp, Homo sapiens
ctctaactgcagcactgtaactggaagactgcagccacctcactatctgcctctacctctccctctatctgatgggctccagaggcttcatccaggcaagaaaaatgtgcagatgctgcggcagctttgatccaggccacttgacctacataagccccagacctcagccatcttggaggaattatgaggtgtatgagatccagagttccgtcagtctctccccagccacaggccgtataatcccctcatccttttggggtcccaggaagtccttcttctggacccagagtccacccactttagagttggtcctgggatctgtcatcctgctcagaatctgggaggaagtgtttatacctagaggaggccaggagggcattgcatctcccactctgtgggcgtgccttgctttcgatgtctccagtgaggatctgactccctggatagaatggagttgaggcccaggggttggcatctgctttgtttgttaaaatatgctagtcatctataaaagtgcctgcacaaagtaaatgcttaacatatgtgtgtttagtgaatgaacaccaaccagaaccttcctagataactgagcgtgcctggggcctctcttctagcacgcagggacttgtattcatagactgtataaagagcattatcccagcaaatcctcaaaaacacaccctcattttagaaatgagcaaacacaggcttttggatgtaagaaggcagctccaaaactgctcacgggaactactgtgtgactttccctctcaactccccgaggcttggtctgcgctgacacggaggaaaaggacctggggaggccttgtttcctcctctgttttagagacagtgacacaggaaaaaactagaagaaccctttggacttaaagccaataactgcttctttgtttaacataaaggcagtcttgagaaacagctaccgcaattgcagacccggcaaagggcccaatgccaggagactcattgggtgggagaaagagcccatcacagtgccacggatctgagcgatgactcagggaggagaaaatccaagtggggactatacagccgaaaggtgacacacacatatcagcagggaagctggaaatgaaaggatcaatggaattttatttgtcacgcagacaccggattgacaaaatattagaagacttgacacccaggggtggctggatgctgggaa

SEQ ID NO: 461249 - DNA, 1292 bp, Homo sapiens
gaggtccccacccctgggacgaggggaagtgggactaaaacgtctacagccccacccggctcccgcggctaccagtgacccagaaggtgcaactgaccaaacgcagcgactcaaccgactgtgctctccccagactcgcagctatggcaacttgaactagccgcccagccacagcaagagtacaggaccccgctgccgccgcttggccgtctgggagttgtagtccatctcggcctcatgatcaaggaattaccaagggagagagtcccgaaaaggaactgcaaatcccaggatgccatatagctggccttcgggtaactttcccggataaaagcctgatcccttggccgcgccctcttgccctgctctattttttttttttgttaaaggaccagcctcctttgtaggaggcaaactccagttagaaagtgaataaaaatgcttccttggccttgactgtaattttactccttgggggacaaaaggagtcccccaggactacggtaagatggggaagtagaaaaagggcaagggagcggtgggaggacagggaaagacaatttctagcactgaaatgtaaaaatccccttaataccagggtccagtatattgttccaaagactcacaaattcttagaagcggacgggaacagagaagattatgtaggccaacctgtttggcctggaaagagtaagggacttgcctaagatcatatggcttattcacggcacaccaaaagtagatatttaccctcccaccagaattataccaaaaaaacaggcaagatatacgaagcaatgcttttcaaggcagcggctatcataccaagaaagaccatgatccctgaaagacaggaaacaaataaagcaagccttatgattgccacaacttactgccttgagagagtttccaagtcatggtgcaaggagagcgaacccaggcagagtccagtggattctttaattggggagacaaagctgagagtttggaaagatgcaggtaggtggagtttgcaggacaaactacgggagtctgatgaaaaccataaacacacaaatccaagaatctcaaaataccccaagcacaggaaacttgaagaaaagtacatcaaggcacattacagtgaaattgctctcaacaagtgacaaaatctgaaaagcatcccgagtaagaaaaaaaaaaaaaaaaaagcagattataaaggagcaaagaaaactttgacataagatttgtccttgtaaacaatgcaagcaacaagaaaatgaagcaatgtttttaaagtactgaaagtt

SEQ ID NO: 461250 - DNA, 736 bp, Homo sapiens
acgtaggctgcatgcactcagccacctgcctggaaggacacgagagccacggcaaaggacgagcaagagcagcaggaaagagaagggccacgggagggccgatgtcccccagccacagaccccctctgctgggcctgcctgggctcccccatcaggtttttcttcagctaaggcagaaagagcctctggaaaatgagaagcatccacctggctgcagaacctgggcaccaaccgctgagaatcttcaggagagaaaattccgatggcagttgagagcaacggtggagcagcgaagcccacaggcagcagagcacacagacctgggaggggtgcagaggtggcatcagcgctatgagggcgtgcaggggaaagctgatgggagggaaagggcaggagttacggctgcctctggtgctgaacggtggacactgtgaatcaagaccaaattcgtgacaaactcacacatttttaaaagaagcaaatcagcaactgccaagtccaaaggagctggccaaagataagaccaaggtcccatgagctatactgataatgacaatggtgatagcaactttggaagccagttaatattggaatatggcaaagccactatcagcctgtttcctgagggaacgcatagagccgaactttctccctgcgcctactccaacaatctggaatgtctgccttggaatattatgtgagaaagaaataaacatctcttgtgtttgaaccatta

SEQ ID NO: 461251 - DNA, 1075 bp, Homo sapiens
acgtaggctgcatgcactcagccacctgcctggaaggacacgagagccacggcaaaggacgagcaagagcagcaggaaagagaagggccacgggagggccgatgtcccccagccacagaccccctctgctgggcctgcctgggctcccccatcaggtttttcttcagctaaggcagaaagagcctctggaaaatgagaagcatccacctggctgcagaacctgggcaccaaccgctgagaatcttcaggagagaaaattccgatggcagttgagagcaacggtggagcagcgaagcccacaggcagcagagcacacagacctgggaggggtgcagaggtggcatcagcgctatgagggcgtgcaggggaaagctgatgggagggaaagggcaggagttacggctgcctctggtgctgaacggtggacactgtgaatcaagaccaaattcgtgacaaactcacacatttttaaaagaagcaaatcagcaactgccaagtccaaaggagctggccaaagataagaccaaggtgcgggtgtgtagaagagatgtccgtgcacaggtgtgcttccgcgtggccatccaattgtggacatggtgatggtgcactgagccccagagagcctgccaaacatttcccattcaggatgcctttgggatctcagtaatgctttgcagtgcccctaaactaaaagaaataactagtagttctgttaatacatagttaggtccaaacaactcaacacctggtatctgacagatgccactgttgccactttgaaattttttaaatattctttggcagttctgtgagcttgctgcagtgtcctagcggcatatcagtgcaaaatttgagaaccacaaactgtggattaggaaccctggttgagtacggcaccccttactccctactaccaaagtgagagatggcagacatgtttgtctccaattttaatagagtaaaatttgtttaaaagagccaatggagtttctgagttgctttatttctccagctatatactaaccagccttctcagaaatctttgtccatgaagaataatctgactcaagtccac

SEQ ID NO: 461252 - DNA, 2773 bp, Homo sapiens
tttaaatgtagcctcccccgctgcagaactgcagagcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccagg

SEQ ID NO: 461253 - DNA, 776 bp, Homo sapiens
  misc_feature (1)..(1): n is a, c, g, or t
  misc_feature (4)..(6): n is a, c, g, or t
  misc_feature (8)..(8): n is a, c, g, or t
  misc_feature (12)..(14): n is a, c, g, or t
nttnnntncctnnnagagttatcatgagaattaaaggaaagaatgcccctaaagttttcagcttgtgcctgacacacagtaaacgtacaataaatgctagctactattactactgcgattacacagtgcaatggactctcttgttcctattcttaattgataccaagtccagaagagaagaagggtgctgcaacgtgaggaaaaaaagagatgcagtccccactgtcatgaaatacagccatataatcaaagaatcccacaattctaccacgagaagtactgtgatcgagagatacataatgccgagagcatttacgagaggatgtggcctgtccaggaggccatatgaggacacagcaagacagccacaagccaggagagaagcccttaccagaacctgcccttgctggcttcctgatgtcagacttccagcctctggaactgtgagaaaatcaatgtctgttgtttcagccatccagtctatggcatttgttatggcagtccaagctaagacagtcagtttagcaagaagttccttgcctttgatgtccctcctcagtaattttctatcccctgaccccctcaccctactgcttggctgtaaatccccacttatccttgctgtatttggagctgagctcaatctctctctcctattacgatacttctattgcaacaatcttaaataaagtcttccttaccattttaacaagcttctgaatatatttttctttagcaagcaaacatgcagggtctctttgtctctttgtacctgg

SEQ ID NO: 461254 - DNA, 1495 bp, Homo sapiens
tttttttgagatggtgttttgctgttgttgcccaggctggagtgcaatagcacaatcttggctcaccgcaacctccgcctcccaggttcaagcgattctcctgcctcagcctcccaagaagctgggattacaggtgcctgccaccatgcccagctaatttttgtattttcagtaaagtcagggtttcatcatgttggccaggctggtctctcgtactcctgacttcaggtgatccgcctgcctcagcctcccaaagtgctgggattataggcctgagccaccgcgcccagccgaagctcagctttacacctggcagcaaatggggaaggaagccctcgggtgggggtgacactagttaacaggatgacgggggtcaggtggctgagccaccgagcccggccctcaagtaggcccttctgtcaggcagcagagacatcgtctcaatgagctgcagtttctcatacatgtcacgggaggaatgagacatataaagatcacaggagtctcaagaggagtgagaccaagacagacactgcggtcccttcttatcttttggatttttccatagttctctggaagcaagggctggttcagataagctggttgcccgtgcttatctacctgcaaaagagcgtttccacctgggcaggccctaagttctctctgatgacatgcttggcctgagactccttgccatagtccttaactactatacaactgcaaccaaccactttacggggtttcccctctctgtcaatttgacagagacctacccattcccccagtttcttttgtcatcaaccttaattaggttgatttggtgctcagcacaaagggcttccaccaacttgacatacacagtctcatcaccgttggatgcaagcacacaaagatgggcttggcgcttgtctaaggctttggtagctttgcgaattccatgtgctaggccatcgtggatgagggctgtcttcaacagctcttgtaaagcagcattaatgtccattacccctccagcagcaatgccttcctcggccatggcagtggaggatgaacatgctggtatatccagatatgccccaaaagttgtgcaagtttagcgctctcctgggttggcacagaggtatttcaacaccagctggatgtgggttgtgctgaaggcagagcagaaccagtgaagggcaggcagggagaggcatggtccagccccatgcagaggaggttcttcaggcaaaggaggactttgaaaaggctgaatcaggagcacttaataactgggctataattaagcaggacccctggtaatgacctccaatcagctcctgggggccttgctttgtcttttctaccagggcaggcactaagcctgacaaggcttggcacctagcagagggcctgcataccaccagtgtgcacaaaaatggatgcaaataacctcaccaagcaaggctggcagggggtttctagcacaccagagcagaagctacctttttactac

SEQ ID NO: 461255 - DNA, 4447 bp, Homo sapiens
tcccagtcagtccagaggctgcggctgtggagaagactgggactgctgagatgtcctctattcttaaagagcatgttcttggagctgatacctctgctgaccttgaagaaactgggcatgtcttaagtattggtgatgtgaagaggacaggaaccattgtggacgttccagtcggtgaggagctgttgggtcgtgtagttgatgcccttggtaatgctattgatggaaagggtccaatgggttccaagacccataaaatcattcctcgaacttcagtgtgggaaccaatgccgactggcattaaggctgtggatagcttggtgccaattggtcgtggtcagcatgagctcattattggtgaccgaaggactgggaaaacctcaattgctattgacacaatcattaaccagaaacatttcaatgatagatctgaagaaaagaagaagctgtactgtatctatgttgctattggtcgaaagagatccactgttgctcagttggtgaagagacttacagatgcagatgccgtgaagtacaccactgtggtgtcagctatggcctcagatgctgccctacttcagtacctggctccttactctgactgttccatgggagagtattttagagacgatggcaaatatactttgatcatctatgacgacttatccaaacaggctgcctgtcctggtgatgtgttttacctatactcccggttgctggagagagcagccaaaatgaatgatgcttttggtggtggctccttgactgctttgctagtcatagaaacacaggccgatgatgtgtctgcttacattccaacaaatgtcatttccatcactgacagacagatcttggaaacagaattgttctacaaagatatccgctctgccattaacattgggtctgtctgtgtcttgtgttggatctgctgcccaaaccaggactatgaagcaggcggcagactctctttggctcatgtataccttcaattgcataagggagagaatatagaggacattccaaaggaagtgctgacagactgcgcccaccttgtgaaggccaatagcactcaaggctgcaagaacaacgttaatgtggtaaatactccacggtctaacctgaagaaaacagctgacgtggatgtgaggcagataggctttcacaggcagaaggatgtaaaaattgtgacaatggagaagaaagtaaatgagatcctgaaccgattagaaaaaaccaaacttaacagatttcaatgcagctttgaggaagcacagcattactgtcatgtgcagagaggattcctagctcatatttggaacaaggaagttcaagatctcatccgggactatctggaagaaggaaagaagtggtggattgggcaaaatgtaatgccattgaaaaagcatcaagacaacaaatacccagcagacgttgcagccaacgggcccccaaagcccctcagctgcacctacctgtccagaaacttcattcggatctcatccaaaggggacaagtgcttactgaaatactatttcatttgccagactggtgactttttggacggagatgcccattatgaaagaaatggaaataattcccatttgtaccagagacacaagaagacaaaaagaggagttgcaatagcaagagacaaaatgcccccagtggattcggatgaaaccggtgataaaatcagaaacaacttcaagcccaaaggaagaaggtcatccgaataccttcacctcttatctacaagtgtcattgcagaaggcatctggtcaggtaaacatgggaaattcaagtcacaggtcatagatgagatagcagggaacttcagcagagcagttcatggtttgcaagctcttaacaaactacaggaagcttgtgagttcctccagaaactaacagccttaaccccaagattttctaagccagctcagaacaacaacagtctgggcttcaaagttcctccaactgtctgcccctttcattccctcaacaatgtcaccaaagctggagaaggaagttggctggaatccaagcgtcatactgagccggtagaagacatcctggaaatgtccttggtggagtttgggaatatcggggaagcatttctagagcagaaccagtctcccgagtcttcagtgactttgacctctgccaatgctactctgctgctgagcagacaaaacatatcaactttaccgctgagctcttacactctgggtcacccagcccctgtgaggctaggctttccgtcggctttagctttgaaggagctcttgaataaacatccaggagttaatgtccaaataacaggactagctttcaatcccttcaaggatttggacaacagaaacattgttggaagcattggaagtgtgttactaagcgctaatcgtaaattgctccaagtccatgatttaatggaggacattgagatcatgctctggagaaatgttagcttggaaacccatcccaccagcctcaacatgagcacacatcagcttacaatcacagtgaacgtcacttccttggagaaatccttgatagtgagcatagatcctgacagtccccttttaatgacactctacctggggttccagtatcagcctaactgcactcacttccacctgaacatcacccttccaaaggataaggtgtggcaaaaagatgaggagtacacgtgggtgctgaatccagagcatctgcagcacgggattggcacctactatataacagctgtgctgagtgagaggcaggagggtgctcagcagacacccagcttggtctcggtcatcaccgccgtcactcagtgttactactgggagatccacaaccagacatggagcagcgccggatgccaagttgggccacagagcacaattctgaggacacagtgtctctgtaaccacctgaccttctttgccagcgacttctttgtcgtgcccaggaccgtgaatgttgaagacacgatcaaactgttccttcgcgtgaccaacaatcctgttggggtgtcactgctggccagccttttaggattttatgtgatcacagttgtgtgggctcggaaaaaggatcaagcagatatgcagaaggtgaaggtcactgtcctggctgataatgaccccagcgctcaatttcactaccttattcaggtctacaccggatatcgaagaagcgctgctacaacagctaaggttgtcatcaccctctatggatcagagggacggagtgagccccatcacctctgtgacccccagaagacagtctttgaacgagggggcctggatgtcttccttctcaccacttggacctctctagggaacctgcacagccttcggctctggcatgacaattctggcgtcagtccctcctggtatgtcagccaggtaattgtctgtgacatggcagttaagaggaagtggcatttcctgtgcaattgctggctggctgtggacctcggagactgtgagcttgaccgggtcttcatcccagtttcaaagagagagctcttttcctttaggtactgttggaaaattactattaacagtgaatattgatgttcactattaattgaattgttcacgattgaattgtttttaatgcaaattaacattttattaatgtattatttcaaacatacataagcattactgttgtggttgtaactggtgtaaccattaccttaaaaatcagaaggaagacaaaaagagattcgaagtataaaaattataaatattgcccttattttctgaaactgtttacctagagaatcatttataaatttactaagatatctaggaataaaagaatcactcagatcaatggaatataaaaaggataccactacttcgatgatacaaatatttatgagaacaaaatataaaaataaaggaaagtattagagggctgtagccttcaactgactttcaaagacactagtaaactggccaggcacctgaatcatttttagtttcagttactgtacaaaagtcaaactcccacttttgtactaccttcctccaggtctggagctcagtaatcctgtggcttctacctcactctgaccaccttgttttctcattctgcttctcttcctcagaaaaggtttattttgtgtttaagcccagcaaagtctttttggttctttctttttatatattatttatagttcctccatatttggagtagagaaagtgctcagagtatgaatttaccaaactattttgagcagaagtttaatgtaaacttttgaagagtaaaaaattcatcaaaactcttataaagctaaaacaaccatttttaattttaaactcgcatagcatataaattatcctcaacaaccttttatcctaaaacaacaaaagaatcttacatggacacattcgggtgatggtaaaagaatttaaaataaaaaaagaattaaaatatctgaaagcttatt

SEQ ID NO: 461256 - DNA, 1817 bp, Homo sapiens
acaacctacccatctgcatgatcctgctagaggtttgagcatccaggcacctaagaagcaagccacacccccatcgcacacccttctaggggcacaaagtctcccttattcatgggacctgcctgggtccaggaccccttgacaggtgctctctggctgcctgtcctctgggcactcttgtcccaggtctattgttttcatgacccaccaggatggcgcttcacttcctcagaaattgtgatccccaggaaagtgccccacaggaggggtggagttgagatgccagaccagctctcttacagcatgcatttccggggccgaagacacgtgattcacatgaagctcaagaagaacatgatgcccagacatttacctgtttttactaataatgaccaaggggccatgcaggagaactacccttttgtcccacgagactgttactacgattgctacctggaaggggttcctgggtctgtggccacattggacacctgccgtggaggtctgcgtggcatgctgcaggtggatgacctgacttatgaaatcaaacccctggaggctttttccaaatttgagtatgtagtatctctgcttgtgtcagaagaaagaccaggagaggtcagtagatgtaagactgaaggggaagagatagatcaagaatctgaaaagtgctccaaattttccatacctaattttccatacgtagctcctcgttgtggagacaatatcaaaaatcagagggaagaatgtgactgtggctcccttaaagattgtgccagtgatagatgttgtgagacctcttgtaccctttctcttggcagtgtttgcaatacaggactttgctgccataagtgtaaatatgctgcccctggagtggtttgcagagacttgggtggtatatgtgatctaccaaaatactgtgatgggaaaaaggaagagtgtccaaatgacatctacatccaggatggaaccccatgttcagcagtatctgtttgtataagaggaaactgcagtgaccgtgatatgcagtgtcaagccctttttggctaccaagtgaaagacggttccccagcgtgctatcaaaaattgaataggattgctgagcacactacatttcgtaatatattagtacacgacataaaagaagaaaaatgctttggctatgaagcacaccaggggacagacttgccagaaatggggctggtagtggatggtgcaacctgtggcccagggagctactgtcttaaacacaattgtacttcttatcaagacctgcattttgagtgtgatcttaaaacatgcaattacaaaggagtatgtaacaacaaaaaacattgtcactgtctgcatgggtggcaaccaccaacatgtgaactgagaggaaaaggaggtagtatagatagtggccctccacctgacaaacaatatcgtattacagccagcacacttgcgaatataaactgagcactacttttaatatttactcgttgcatcctttttctggtttcacttctctttggtggcttttcacaagcaatagaatttatggaagagaaaataatgaaaactactgaacctaatgagtaaatactaatggaagcccacacaatggagaaaatcacgttgacacttactgggagttataatcaatagtcactctgacggttacatcaccttttagcaattctgatgtcatcttgaagtaaaatcacttggcaatttaaaaagggtctgtgtgtttaaatttacttcacatttcatgtgtggtcgtattctcaatacttctatagatgacggcagaaactcttagattcact

SEQ ID NO: 461257 - DNA, 2505 bp, Homo sapiens
aaatggttgttacaattgcatggaaggtaaactgaggcccagaggccccaacaccacagagccacgtctactcaccagcccccagcccccaccactccccgcacagtgtcctccatcatgctgtggggagctggggtcctgccgtgcagacacactgggggaccaggtctgcagggactcgctgcagaaccaggagtcccagggcacacgagcctccctgcccaggttgctggcaagcccctggggcaaggtggaagcccatttggcagctgaggccctggtgcctgaggccatcaagggaggtcagaagggacaaaggccacggctcggccgagaggagggtgccgtccgctctgctcaggcactgggccgggtgccagcagcaccacgttcccacgctctatggtgccaatcttggcaccccagccctgccccacccttgccttgcagggaccagggcaccgggaatgtggctgtggattccgccccctggggccacggattcctgtctcagtgggcgggggtggaggacggctttccaccctttgatccttgccaggagaaggcgctaaaggtgagcgccggctgcagggcggaggactctggcctctgcggggccgagccacggagccacctggcttgcggggatccctgggacccagccttgttctactgcccacttgacgcggcgggcaccctccttcctggtggccaggaacgctccctggaggagggggcccggaagctccctggctgcaagagtggattcctgagcaaaagctccgcgggtggagaaagagagtatggcgggggccacgggggtccgagtcccgacacgcggctgcgcactcgctcccctgcaccgcgggcggggctggggccggagacgcgcgcggcggcctcggattcctgcgcggtgggacaagcccgcgcctgcgcccgcccggacagggcacgtcgcccgcgagtggggtggcgggcccaggaggaggggaccccgacagcccctcaccgcctgccggggcgggccgccacgctggacgggggcagcgcggggcggggtcggggggcggcagaaggcgcctttgtgcgtcgcgtccccgagcgtgtcgcggcgggcccggcaccggccccgctccagcgcccgcccccggcccgcgccccgggccccgcgcgcatacctggcgaggccacgaggggattctgcgggccgagccccgccgtggctgcgcgccgcaggcgggagaggctgaggattcttttgggaagcccctccgccggctgtggctgccgcggcgatgtgggcggcttgcgtgtggccgatcgggagtttggccagcttcacgctccatcagtggtctcaccatagaccttctaatcttgattgtgttggctggtgtctattttctaatggtgtttggttttggaacctgcatttctttgaaaaagagtgagcatgtgcattttcccagatgcctggtatccaactgcacttctccatgtgtgcattgtcccctgagctggcaagaagatcctactagttggtctgcatgccatgccagctcggccttgcaccctgggggcccaggtaactagctctcaccaacagaaagagatgtgatggacatcacctgaggccagaccctaagacctctgtgtgccccctccgtgtctcctgtctgcagctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggattgagccatcagcattctgtggtgggcgtcgctgctgcgaggttgccctcgtgcacacaagctcctcacaggacttccaggatgatatggaagagtgactgagagcagccgcccggtgcttcccaaccttagagggaggtcacgggcagtctccctgcgatgctggccacaggtggtctcgctgtgtcgcccaggctggagggcagtggtgtgatctggactcactgcagcctcgacctgttgggctcaagtgatcctctcacgtcagcctccaagtagccaagaccacaggcaggcgtcaccatgcccagcccccatgatgactttacttttcttcttgaacctggtgaatttctgtgttaacatgtctgatttgaacccttctgatattcctgagataaactttatgtgaccttggtattctgttggattttggttagctgatacttcaagatttttataaaactgggttgcaatttatttgtgttcccgtttctagctgtctatgagcttcatcaaatgggcaggaccactttcccttaacttctccttttctggaacaacggacatatcctgtggattatctgttccccacaggtttgggatatgggtgctgtgaatgccactgtgctgggggctttgggaagtgtgtgtttgttttc

SEQ ID NO: 461258 - DNA, 1876 bp, Homo sapiens
cggggtggcgctcggacagaggctgcaatctcagcacttctgggaggccaaggcaggcggctgggaggtgtaggttgtagtgagctgagatcacgctactgcactccagcctgggcaccattgagcactgagtgaaccagactccgtctgcaatcccggcacctcgggaggccgaggctggcagatcactcgcgattaggagctggagaccagcccggccaacaaagcaaaaccccgtctccaccgaaaccagtcaggcgtggcagcgcgtgcctgcaatcgcaggcactcggcaggctgaggcaggagaatcaggcagggaggttgcagtgagcctgagccgagatggcagcagtacagtccagcttcggctccgcatgagagggagactggcgaggccacgaggggattctgcgggccgagccccgccgtggctgcgcgccgcaggcgggagaggctgaggattcttttgggaagcccctccgccggctgtaaccccagggccgtgccaccctcctgatcaccgcaagcatggaccccccagcacgctgcgggtgggacaggcagggcccctgtggggtggcttgactggcctggagttggggacgaagtccccgggcttggtcccccgagggcttggttgggcgtcccggggtggctgccgcggcgatgtgggcggcttgcgtgtggccgatcgggagtttggccagcttcacgctccatcagtggtctcaccatagaccttctaatcttgattgtgttggctggtgtctattttctaatggtgtttggttttggaacctgcatttctttgaaaaagagtgagcatgtgcattttcccagatgcctggtatccaactgcacttctccatgtgtgcattgtcccctgagctggcaagaagatcctactagttggtctgcatgccatgccagctcggccttgcaccctgggggcccaggtaactagctctcaccaacagaaagagatgtgatggacatcacctgaggccagaccctaagacctctgtgtgccccctccgtgtctcctgtctgcagctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggattgagccatcagcattctgtggtgggcgtcgctgctgcgaggttgccctcgtgcacacaagctcctcacaggacttccaggatgatatggaagagtgactgagagcagccgcccggtgcttcccaaccttagagggaggtcacgggcagtctccctgcgatgctggccacaggtggtctcgctgtgtcgcccaggctggagggcagtggtgtgatctggactcactgcagcctcgacctgttgggctcaagtgatcctctcacgtcagcctccaagtagccaagaccacaggcaggcgtcaccatgcccagcccccatgatgactttacttttcttcttgaacctggtgaatttctgtgttaacatgtctgatttgaacccttctgatattcctgagataaactttatgtgaccttggtattctgttggattttggttagctgatacttcaagatttttataaaactgggttgcaatttatttgtgttcccgtttctagctgtctatgagcttcatcaaatgggcaggaccactttcccttaacttctccttttctggaacaacggacatatcctgtggattatctgttccccacaggtttgggatatgggtgctgtgaatgccactgtgctgggggctttgggaagtgtgtgtttgttttc

SEQ ID NO: 461259 - DNA, 1715 bp, Homo sapiens
aaatggttgttacaattgcatggaaggtaaactgaggcccagaggccccaacaccacagagccacgtctactcaccagcccccagcccccaccactccccgcacagtgtcctccatcatgctgtggggagctggggtcctgccgtgcagacacactgggggaccaggtctgcagggactcgctgcagaaccaggagtcccagggcacacgagcctccctgcccaggttgctggcaagcccctggggcaaggtggaagcccatttggcagctgaggccctggtgcctgaggccatcaagggaggtcagaagggacaaaggccacggctcggccgagaggagggtgccgtccgctctgctcaggcactgggccgggtgccagcagcaccacgttcccacgctctatggtgccaatcttggcaccccagccctgccccacccttgccttgcagggaccagggcaccgggaatgtggctgtggattccgccccctggggccacggattcctgtctcagtgggcgggggtggaggacggctttccaccctttgatccttgccaggagaaggcgctaaaggtgagcgccggctgcagggcggaggactctggcctctgcggggccgagccacggagccacctggcttgcggggatccctgggacccagccttgttctactgcccacttgacgcggcgggcaccctccttcctggtggccaggaacgctccctggaggagggggcccggaagctccctggctgcaagagtggattcctgagcaaaagctccgcgggtggagaaagagagtatggcgggggccacgggggtccgagtcccgacacgcggctgcgcactcgctcccctgcaccgcgggcggggctggggccggagacgcgcgcggcggcctcggattcctgcgcggtgggacaagcccgcgcctgcgcccgcccggacagggcacgtcgcccgcgagtggggtggcgggcccaggaggaggggaccccgacagcccctcaccgcctgccggggcgggccgccacgctggacgggggcagcgcggggcggggtcggggggcggcagaaggcgcctttgtgcgtcgcgtccccgagcgtgtcgcggcgggcccggcaccggccccgctccagcgcccgcccccggcccgcgccccgggccccgcgcgcatacctggcgaggccacgaggggattctgcgggccgagccccgccgtggctgcgcgccgcaggcgggagaggctgaggattcttttgggaagcccctccgccggctgtaaccccagggccgtgccaccctcctgatcaccgcaagcatggaccccccagcacgctgcggctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggatttgaaaaaacacgaaaaaaagaaaaaactacagggagagatcaaatgtcgagagatgcagaaacaaaagagggtactagaacagtggcgcaattggtaaatagcagagtaacaagagaaccagagattttatagaacgaaaggtgataaactaggggtatcccaataagagagcagaataaattcagaagcagtgtactgatataatggc

SEQ ID NO: 461260 - DNA, 1474 bp, Homo sapiens
cggggtggcgctcggacagaggctgcaatctcagcacttctgggaggccaaggcaggcggctgggaggtgtaggttgtagtgagctgagatcacgctactgcactccagcctgggcaccattgagcactgagtgaaccagactccgtctgcaatcccggcacctcgggaggccgaggctggcagatcactcgcgattaggagctggagaccagcccggccaacaaagcaaaaccccgtctccaccgaaaccagtcaggcgtggcagcgcgtgcctgcaatcgcaggcactcggcaggctgaggcaggagaatcaggcagggaggttgcagtgagcctgagccgagatggcagcagtacagtccagcttcggctccgcatgagagggagactggcgaggccacgaggggattctgcgggccgagccccgccgtggctgcgcgccgcaggcgggagaggctgaggattcttttgggaagcccctccgccggctgtaaccccagggccgtgccaccctcctgatcaccgcaagcatggaccccccagcacgctgcgggtgggacaggcagggcccctgtggggtggcttgactggcctggagttggggacgaagtccccgggcttggtcccccgagggcttggttgggcgtcccgggctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggattgagccatcagcattctgtggtgggcgtcgctgctgcgaggttgccctcgtgcacacaagctcctcacaggacttccaggatgatatggaagagtgactgagagcagccgcccggtgcttcccaaccttagagggaggtcacgggcagtctccctgcgatgctggccacaggtggtctcgctgtgtcgcccaggctggagggcagtggtgtgatctggactcactgcagcctcgacctgttgggctcaagtgatcctctcacgtcagcctccaagtagccaagaccacaggcaggcgtcaccatgcccagcccccatgatgactttacttttcttcttgaacctggtgaatttctgtgttaacatgtctgatttgaacccttctgatattcctgagataaactttatgtgaccttggtattctgttggattttggttagctgatacttcaagatttttataaaactgggttgcaatttatttgtgttcccgtttctagctgtctatgagcttcatcaaatgggcaggaccactttcccttaacttctccttttctggaacaacggacatatcctgtggattatctgttccccacaggtttgggatatgggtgctgtgaatgccactgtgctgggggctttgggaagtgtgtgtttgttttc

SEQ ID NO: 461261 - DNA, 1503 bp, Homo sapiens
gcaaaaagggtaccgctccccactccacactgccccagtccagttcacagcactgagatgttgacctgggaggcagtgaggccagacctggatggccagccctggcagatgtcctctgttccttcacgtgagctgggaaacagggaaatgggaccttgcttgcccaggcccacagactcagctctcttggcctcagctaacttatgtgggtttgagttggtgcttggtatgactgtcacagcctccatcaccagggggctctggaacatcctggccttgggcagatcagggaggatcatttcaaatgctgtcacatcagcagctgcttataccaccatcaggaaacacgcttcccacacaaacctcaccaccgtccacccaggctcctgcagactggccagggcaccagatgctaccagttcactggaaagtacactgaccttggagtccatagccctgggttggagtctcccctctgccatcgactatctgtctgattctagtttccagttcaagttcaccttgactgagattcaggatggagtggtgatttggccccagccccgagacattgcaatgctagcactgactacgccacttgtgaaggcttgtaaaacctctgaagccccagcccagcacgggcctgagctgctccagcaaccacgggccgtgagcaggtattgaattatgaatggatgttgcccagaaataattgcaaacattattgccccccatacatgtgtgtcctccgcggggctacagcaatagattttgttgctttaacactccagcctgggcaaaagagtaagactctgtctcaaaaacaaaaacaaaaacagaaaaaaacacaatcagattagagagcccacaccctctaagtcagaatgtgaaatggtgaggccaataagatttatttttcaaatcttcccaaggcttctagtgcccagcagactggtttgcaaaccagtcttctaaagcaatcttctttctatcattaaggagcccatgacacagaggtgttaagttcaaggtctcttgggtcagcttttggatccactgttccaaagggacaggttcttagggggctggcattttcttggagtgaagcaggagctgctgcaggggctgagaaagcaggaaggagctctttgctgcattccagagcagatctggctgtgaataaacgagaaagagctttagtgtaagctgggctgaatggataattaaacagatagcaaaatggaatgcagttgcacacacctcccgggagctggctggggggagataatatgccttcctgtcgtcagaaggcacaggaggaaaaacaactgggcctggccgttggccatttaacaatattgcttttgtaaacaagttgaaaaatccaataactgtaaaacttatggcatgtccttaaaagcctgttgctgttttccctataaatggatgagcgtttccgactgaaggtgttctaattaaacagtccgcatccccaaggactgc

SEQ ID NO: 461262 - DNA, 294 bp, Homo sapiens
aatggatgttgcccagaaataattgcaaacattattgccccccatacatgtgtgtcctccgcggggctacagcaatagattttgttgctttaacactccaggttcattataaattagagctaacacattaacagtgggtcagggtacatggggagagggaatcccgtttgcaagctctaaaagggacagatccctcaacggcacacgttggttactctcaactgttcctttcttttgatctattccacccatccctattaaataactaattatttaacatcttttaaagctttg

SEQ ID NO: 461263 - DNA, 1206 bp, Homo sapiens
  misc_feature (1170)..(1170): n is a, c, g, or t
gcaaaaagggtaccgctccccactccacactgccccagtccagttcacagcactgagatgttgacctgggaggcagtgaggccagacctggatggccagccctggcagatgtcctctgttccttcacgtgagctgggaaacagggaaatgggaccttgcttgcccaggcccacagactcagctctcttggcctcagctaacttatgtgggtttgagttggtgcttggtatgactgtcacagcctccatcaccagggggctctggaacatcctggccttgggcagatcagggaggatcatttcaaatgctgtcacatcagcagctgcttataccaccatcaggaaacacgcttcccacacaaacctcaccaccgtccacccaggctcctgcagactggccagggcaccagatgctaccagttcactggaaagtacactgaccttggagtccatagccctgggttggagtctcccctctgccatcgactatctgtctgattctagtttccagttcaagttcaccttgactgagattcaggatggagtggtgatttggccccagccccgagacattgcaatgctagcactgactacgccacttgtgaaggcttgtaaaacctctgaagccccagcccagcacgggcctgagctgctccagcaaccacgggccgtgagcaggtattgaattatgaatggatgttgcccagaaataattgcaaacattattgccccccatacatgtgtgtcctccgcggggctacagcaatagattttgttgctttaacactccagcctgggcaaaagagtaagactctgtctcaaaaacaaaaacaaaaacagaaaaaaacacaatcagattagagagcccacaccctctaagtcagaatgtgaaatggtgaggccaataagatttatttttcaaatcttcccaaggcttctagtgcccagcagactggtttgcaaaccagtcttctaaagcaatcttctttctatcattaaggagcccatgacacagaggtgttaagttcaaggtctcttgggtcagcttttggatccactgttccaaagggacaggttcttagggggctggcattttcttggagtgaagcaggagctgctgcaggggctgagaaagcaggaaggagctctttgctgcattccagagcagatnctgctgagtggtatttgtattctttaatattaaaca

SEQ ID NO: 461264 - DNA, 1015 bp, Homo sapiens
tgtgtcaaaacacataaattttattgttagtagagtataactaaatttaagaagcccttactatgtgcaaagtacaaattctgtgtgggatacaaacaaggccttgttcatatctttagggatcctggaatctcgggaggtgacagaccagtgcacgtattgcaaccaattgaggtgtaagagacaatatgaaattgctatgagcaagttgattcagtcactcaacaagtattcacaggcactgtgtgaactctaaaagcaaattacttctctctgaggcaggcgaggcaaggtcacagaagctttatggaactgagcatttgggctggtgtttgaagaagaggttaaaatttgtcaggcagagcagaagggaggcaggtgtgacaaaggtcatgtgggagtcaaaggcgtgggaaagtatagggtgtgcttgggaaataagaactcagtgcagtacctctcttctgcagaccagggtcgtgtctgtttacttcatttccagtgtcaaatctgtcatctggaaagggtgtgaaattcatcctgaagaacagccagctgagtacccacttggatattggcatcttctgggttacaagagccttgcaattaaggatgagccaacagacctagccctcaacactcagctgaccaacaagcaaagaaagagcaaggaggcccacatggtgtactttaggggccgggcctggaaggggtatatcccacctccatcccatgggccattggccgggactcagtcacatgatcccacttacatgcaagatagcatatgtgctttggtagtgtagaaagaagagaaaggaagaagaagagagagattggtgaacagtagcatctatatacacccaaagggggtaaagaattcctatcagttggatgttggacctgctagaacaggagtaagcaagttttttggtaaagggccagagatttattttctgttctctgcattatttctctttctgtttgtctatttttgtttcctttcattcagagg

SEQ ID NO: 461265 - DNA, 1121 bp, Homo sapiens
aacaaaaggcttccacttctgaaaagaaagtttgaaaacctttgatggggagctacagatttcaagcacaggagtgcttaaagaagtaactattctgaagtgttctagttctttgaggaatgctgatgtatggataaagtatggtggagcaaagaacactggaccagaagttggggaggtcgccttagctccaccactgtgtctcaccgttaaattcatctacagggatcctggaatctcgggaggtgacagaccagtgcacgtattgcaaccaattgaggtgtaagagacaatatgaaattgctatgagcaagttgattcagtcactcaacaagtattcacaggcactgtgtgaactctaaaagcaaattacttctctctgaggcaggcgaggcaaggtcacagaagctttatggaactgagcatttgggctggtgtttgaagaagaggttaaaatttgtcaggcagagcagaagggaggcaggtgtgacaaaggtcatgtgggagtcaaaggcgtgggaaagtatagggtgtgcttgggaaataagaactcagtgcagtacctctcttctgcagaccagggtcgtgtctgtttacttcatttccagtgtcaaatctgtcatctggaaagggtgtgaaattcatcctgaagaacagccagctgagtacccacttggatattggcatcttctgggttacaagagccttgcaattaaggatgagccaacagacctagccctcaacactcagctgaccaacaagcaaagaaagagcaaggaggcccacatggtgtactttaggggccgggcctggaaggggtatatcccacctccatcccatgggccattggccgggactcagtcacatgatcccacttacatgcaagatagcatatgtgctttggtagtgtagaaagaagagaaaggaagaagaagagagagattggtgaacagtagcatctatatacacccaaagggggtaaagaattcctatcagttggatgttggacctgctagaacaggagtaagcaagttttttggtaaagggccagagatttattttctgttctctgcattatttctctttctgtttgtctatttttgtttcctttcattcagagg

SEQ ID NO: 461266 - DNA, 831 bp, Homo sapiens
gcctgcgatggtttcaacatatgacccgaaaagtattatgttgaaacctaatcattggtgtgatggtattaggaggccctcaccagatattggatccactggcaccttgatcttggaattcccagcccccagaaccatgagaagtaaatgcacatgcacgcacacacatatcttgttaaatgaaaacagcaacacactctacatgctgttctgtaacctgcttgtgtctttcacttacattatgagaatgttcccctgtcaagaaatggaagtcaaggactcagcagtccaaggcagcccttctgaagcaacttcaggggctcagcaaatatttgttgagaacctcctctgtgcctggctggatcagggtggggctgtagagctgcacatcatagtctgcatccgggtcagccctgaatctcaggcactggaaggttaccctgatgggcaggacccactcccatcactaagagaacatcaaaagggcaggtgtgggggtggataggaagatcaggatctctgaaaggattggtcttttgagatgtttttcagaaatttgcattgtggtaacctacagactccacctggacccatgattcatgactcaaccagtccacccagaagctgactcagagcataaggagcattttccacacccctaggatttcatctccaaccaatcagcattccccattctctagcccctgtccaccaaactattctttaaaaaccttagctctaagctttatttatttatttaagtaatacactcctgtcttccacttagctggttctgtatttattaaactctttctctactgccataccgct

SEQ ID NO: 461267 - DNA, 781 bp, Homo sapiens
gcctgcgatggtttcaacatatgacccgaaaagtattatgttgaaacctaatcattggtgtgatggtattaggaggccctcaccagatattggatccactggcaccttgatcttggaattcccagcccccagaaccatgagaagtaaatgcacatgcacgcacacacatatcttgttaaatgaaaacagcaacacactctacatgctgttctgtaacctgcttgtgtctttcacttacattatgagaatgttcccctgtcaagaaatggaagtcaaggactcagcagtccaaggcagcccttctgaagcaacttcaggggctcagcaaatatttgttgagaacctcctctgtgcctggctggatcagggtggggctgtagagctgcacatcatagtctgcatccgggtcagccctgaatctcaggcactggaaggttaccctgatgggcaggacccactcccatcactaagagaacatcaaaagggcaggtgtgggggtggataggaagatcaggatctctgaaaggactccacctggacccatgattcatgactcaaccagtccacccagaagctgactcagagcataaggagcattttccacacccctaggatttcatctccaaccaatcagcattccccattctctagcccctgtccaccaaactattctttaaaaaccttagctctaagctttatttatttatttaagtaatacactcctgtcttccacttagctggttctgtatttattaaactctttctctactgccataccgct

SEQ ID NO: 461268 - DNA, 806 bp, Homo sapiens
gcctgcgatggtttcaacatatgacccgaaaagtattatgttgaaacctaatcattggtgtgatggtattaggaggccctcaccagatattggatccactggcaccttgatcttggaattcccagcccccagaaccatgagaagtaaatgcacatgcacgcacacacatatcttgttaaatgaaaacagcaacacactctacatgctgttctgtaacctgcttgtgtctttcacttacattatgagaatgttcccctgtcaagaaatggaagtcaaggactcagcagtccaaggcagcccttctgaagcaacttcaggggctcagcaaatatttgttgagaacctcctctgtgcctggctggatcagggtggggctgtagagctgcacatcatagtctgcatccgggtcagccctgaatctcaggcactggaaggttaccctgatgggcaggacccactcccatcactaagagaacatcaaaagggcaggtgtgggggtggataggaagatcaggatctctgaaaggaaatttgcattgtggtaacctacagactccacctggacccatgattcatgactcaaccagtccacccagaagctgactcagagcataaggagcattttccacacccctaggatttcatctccaaccaatcagcattccccattctctagcccctgtccaccaaactattctttaaaaaccttagctctaagctttatttatttatttaagtaatacactcctgtcttccacttagctggttctgtatttattaaactctttctctactgccataccgct

SEQ ID NO: 461269 - DNA, 3237 bp, Homo sapiens
cgtgtttttcttccgagcatacaaatatttgcaatgaggttgcaccgcagactccacagccattgtggcacctggggctctgtgacttgggaggcagaggagatggaatgccggggccaccggcatccttcggctcatggcctcttcctccatcttaaaagccagcttctgcaaattcctgctgtgggtgcctggaaaccctattggactaggactggccccggcaaaaaacaagtgttatagctgcccagtgtcctctgagtggatgctggtgattctggtatggagcccagatgtaaggcagcaggtggtccagaaggcaccagaagaggtctcctgtcaaagtcagggccagagaagaaggcacagggaacctactgcacgagactttcacttgcaacgagcaacccatgatgaggagggaggattcctgggggcattgagtcccccagacacaaggacccaagaccttcttgcttggaaagtgaattcctcagaattccgagatgatgccagtcttggaggaagatgacatgaggacccaaaaccttcttgcttggaaagtgaattcctgagaattccgagatgatgccagtcttggagaaagatgacatgaggacccaaaaccttcttgcttggaaagtgaattcggccagactgaagggacagtggccattgcatcaagtcagagaacggatctgacccatctagtagaagcttattgttttggcagaagcacaagctcttagaggtgcagctgcagggtgtgacctattggggacattgagctcagtgaccatgggccctgagagtctgaaatcctggaatttctcccaaaacgaagtccatgtagggaagccaaagtgtgagtcttacccggctggtttacaactgactgacatttgctgcctgggcagctgttgtgggtgcctggaaaccctattggactaggactggccccggcaaaaaacaagtgttatagctgcccagtgtcctctgagtggatgctggtgattctggtatggagcccagatgtaaggcagcaggtggtccagaaggcaccagaagaggtctcctgtcaaagtcagggccagagaagaaggcacagggaacctactgcacgagactttcacttgcaacgagcaacccatgatgaggagggaggattcctgggggcattgagtcccccagacacaaggacccaagaccttcttgcttggaaagtgaattcctcagaattccgagatgatgccagtcttggaggaagatgacatgaggacccaaaaccttcttgcttggaaagtgaattcctgagaattccgagatgatgccagtcttggagaaagatgacatgaggacccaaaaccttcttgcttggaaagtgaattcctcaaaactccacaaagactccagtcttggaggaagatgacatgaggacccaaaaccttcttgcttggaaagtgaattcctcagaactccacgaagactccagtcttggaggaagacgaggtgttgagagatagctgggatccctgaggaaggcagccccagtctccggtggagaattaagaggggcccaagcagatggttggtggtggaaacgtcacctcagtatagtactatggagtttcctttcacccccaacagccgacggtttccaggggcgaagagtgaaaattgaagcaaggtgtctactgtccagcggtagacaaggaggcagtgcgcctgccacccccaaggaagagtcagttcagaagcacagcagctgctggaaacccaggaggtttccagttcgttcctgctgggacctggcaagaactgcactgtcaaggctgcaagaggctcctgacggcttctgacatgtacagaatggaataagagaacctagcagaaatggaagcagaggcaagaggtctggaggccaggaaaatgtcaatggaaagcagctagcatgaagaccccacagtgttcctccctctagtagtctggtattatttggagctgagatgctcccaatatggttgggacatttgtcccctccaaatctcatgtgagaatttgatcccccattttggggatggggtctaatgggaggagtttgggtcatgacgggggacccctcaagaatggctttgtgccctgctcaccaggaatgaatgagctctcactctactagttcactggagagctggttttttaaagagcctggcgtctccccaactttctctcttgctcccccttctcactgtgtgatatacctgctcccctttgccatccatcatgagtggaagcttcttgaagcctccacctaaagcagatgccgacactatgcttcctgcacagcctgccataccatgagccaataaacctgttttctttgtaaattacccagcctcaagtattcatttgtaacaatgcaaaatggacaaacagaaaattggtactgaggagtggggctttgctataaagatagctgaatatgtggaagcagctttggaaatgagtaaattggcagatattggaagaatgtggagggcttagaagaagacaggaagatgagggaaactttgaaactgtcaaccaaaggatgatgaggttcataaatgtggaaaggagagctgtatttcttataaatggttgcagcctgcagggtggccattccgagtgtctgcgaagcatagcctctggccagaagccagaaacaggcacttggagtgtcagaagaataaaacaaggatttgtgctgaatgaggtggccaaatatatattcagcaagttataggaggagccatgaatatttacgaaagaagaaacacatgtgcagttgacctcccagccccttcatgggttcgcatgttaaaaaaatggtagtattagcaagatgtgagggggcagtttttgggtctctgacttcaaaagatgaagcagtggacacaaaacccgtcagtcagtgcacagcctccctagactgactagaacctctcagtggttggtggtctcttatcaggaaggaatgctgcttggttgttctgttgaaactgcaaaagggagggacagcatcaggtggttggttgaaatcagtggtgaggtgactcttttgaaagggctggttccaacccaaatgctcatcagtgatagactggataaagaaaatgtggcacatgtataccatactatgcagccataaaaaagagtaagttcatgtcctttgcagggacatggatgaagctggaaacc

SEQ ID NO: 461270 - DNA, 2050 bp, Homo sapiens
ctgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagacacagtgaggggaagtcagtgtgagcccagacacaaacctccctgcagggtccccaggaccaccaggggcgcccgggacactgtgcacgggtctgtctccagggcaggtgcagttcctgctgagggctggcttcctgtcatggcctgcggcgccctcattgtcaaatttccccagggaacttctccagatttacaattctgtactgacatttcatgtctctaaatgtaaaacttttttgtcctttttgtttctttgtttttgtaacaggaggacacaccctcacctccacagaaaccacagtgtcactttgggggcagatgatccttctgtggtcagcaggatgaaagttccgaggaatctcaggggaacccgaagagtgtttgccagttagactcagggcagcgacctccacgggaatctctgattagaacaggctttgagttctgataggagccaagagagacgctcacacagggtcagggtccttaaagcctgatggttttcacagctatcccccctggtcttgtaaaactgtgtacatatgactcagactgattcacttgaccccctttctgctaatccattttccttctctgcatacttgattctcacaattccctttcttctcttccccgaaaactgaggatgtgttttctgtagtctaaattccagggctcaggtctgcaggacctgggtaggctacggggactttctcactcaccattgtctggactctcctgttgtcgtctgtgaacggatgtttggaagatgaagtggacattagtcatgaagggaataatactagttttctccaatgggatactggatgtagagctgatcttgtgcttctcacactgtcacagagtttggactctcacccgtgactttgaggagagctgaggatggacactccattgtgctgtgagctctgggtaacaatagtagggccctggctaggcagcctaaggtcaatactgctggccttcaggaaagacaggctggaattcctgggaagacctgcatctgccgtccaccatggagtcccatcgtcttctattatgccctgattgaatcagccccacctaggttatctagaacactcttcgtgacttacgaaaaaataatgggaggctctactaacacctgtgttatgccatgggagcaacacctaagctagtgtgtgattgagtagatgagactgtggtctagtcaaggtgacacataaaattaattgttgccattataatattttattatatatttggcaatatagtcgtgctcatattataaatacttttgctacgttgttgttatgtcagaagcttttgaataagaacagcttcatcttgaataggggctaggaaaaataagactgagacctgctgggctacgttcccagtaagctaaggcgttcttagtcacaggatgagataggaggtctgcacaggatccaggtcataaagaccttgctgatgaaggttacagtaaagaagctggccacagcccaccaaaaccaagacagtcacgaaagtgatctctattcatcctcactactcattatatgcttattgtattgccttaacatgctaaaagacactccccctagtgcatgaccgtttacacatgtcatggtaacatcaggaagtttccctgcatggtctacaaaggaggggagg

SEQ ID NO: 461271 - DNA, 1330 bp, Homo sapiens
aattcgcggccgcgtcgacacggcgagaagacgacagaaggggagactcagggcagcgacctccacgggaatctctgattagaacaggctttgagttctgataggagccaagagagacgctcacacagggtcagggtccttaaagcctgatggttttcacagctatcccccctggtcttgtaaaactgtgtacatatgactcagactgattcacttgaccccctttctgctaatccattttccttctctgcatacttgattctcacaattccctttcttctcttccccgaaaactgaggatgtgttttctgtagtctaaattccagggctcaggtctgcaggacctgggtaggctacggggactttctcactcaccattgtctggactctcctgttgtcgtctgtgaacggatgtttggaagatgaagtggacattagtcatgaagggaataatactagttttctccaatgggatactggatgtagagctgatcttgtgcttctcacactgtcacagagtttggactctcacccgtgactttgaggagagctgaggatggacactccattgtgctgtgagctctgggtaacaatagtagggccctggctaggcagcctaaggtcaatactgctggccttcaggaaagacaggctggaattcctgggaagacctgcatctgccgtccaccatggagtcccatcgtcttctattatgccctgattgaatcagccccacctaggttatctagaacactcttcgtgacttacgaaaaaataatgggaggctctactaacacctgtgttatgccatgggagcaacacctaagctagtgtgtgattgagtagatgagactgtggtctagtcaaggtgacacataaaattaattgttgccattataatattttattatatatttggcaatatagtcgtgctcatattataaatacttttgctacgttgttgttatgtcagaagcttttgaataagaacagcttcatcttgaataggggctaggaaaaataagactgagacctgctgggctacgttcccagtaagctaaggcgttcttagtcacaggatgagataggaggtctgcacaggatccaggtcataaagaccttgctgatgaaggttacagtaaagaagctggccacagcccaccaaaaccaagacagtcacgaaagtgatctctattcatcctcactactcattatatgcttattgtattgccttaacatgctaaaagacactccccctagtgcatgaccgtttacacatgtcatggtaacatcaggaagtttccctgcatggtctacaaaggaggggagg

SEQ ID NO: 461272 - DNA, 3431 bp, Homo sapiens
gcactgggcctcctgaaaaaagcaattactggctccgcggtttcaaagcggcccaaggccgcttgatgaaaggagataagctggggaccgtttccaggatccccgcgggccgaccggggcagcccgggagccgaggtgcggcggagagcccgcggatcaaaggaatctggagagaaaggggaagcgggcggccggccccggccggccttcccccccgcaggccacgccgacctggggtggggggctgcgggccgcgggcggggactccgggatttcccgcctgcctgagtcggggcctacgccggcgcccgcttcgggcggctcggcccggaggggagctccggagagcccggggctcgcaggtaagcaccggcgctccgcgggccgggccggggacgcaggacaaggcgcggggcccaccccggctggctcgggagtggcggtcgcgcgggcccggctcccgtctccggcgtctcccggctccggcggccgggaccccccgcggccgagcccctggccaggccccaggccggcgccttcggaagcgacgtctggcgggccgcggggcacgagggggagagccgggaagcgtaaatccccgaagcgcgcggagatccgattagcgcgcggctattcattaggctgggggcgattgaattaggtccctgggcgcggtcgccggctggggcacagagacctccctcaactggagggcagcagcagctcacccccaccccagaatcagtgttccagaggacagctgggggcagggggttaggaacaatcccactccctcctggaagaggtcctgaccccccaccccacccatctgcctgtacgggtccctctgctatcgactggggcgagttcttttcatgagggccttgcctggtgcctggagggaacagggtgtgggggaaaggtctgtgtgttcccccctcacctcccctgctcagcggtgtggcctctggctctggggaggatcgggaagccccagggtccgtgccttggagtggggggacagccttttctctgccacagcttctgcctttgggggcttacccttcctaggagcagaactgttgtggaggggaagaggacggtgaaggttccgaagggaagggggctgcccccactgaaaacgaagcttccagtcacagccccttcattatttatcaggacccaggggatgaggtggcaggggagggggctgcatggagggagtgccctcaccctcgtccccagcgcctgccccctcccgaccaggcctgggctgaggcccagggtaagggggctgaggcaggccacagaggagcaagacttgtcaggggccagacctgggtaggaggattgtcctccaggcacacacggcccccagccccccagcctgtcgaactgggctctcccagaaggtccccggctccagcccaagcagggagccaggttgggggtgtgggaaggcagaagtcccagggatcctgggggaggctcaggttgtacctgcaggccacagtctcctcgacagacctcggacgaggttgtaagtgttttaaagaaactagagcagcagagaagagagactcagaagcccgtggcacggctttctcggcgtcccctccagcgagggggtctccattgctgcagttgccggttttgtccaaccaggtcaggaggctgcccggccccctccccactctcaaagttgcttgttaaacacagagtcgtaatttgtggctaaatataactagtgtgttctcacggaaagtataattcagggtgctcattgtatgaggttatcaacaagacccatctgggttaaattaaagtgattttcataaagggcagaagcgcccctttgcctggtttcccctgcctttttattagtgacagtgttattgttgcaattattagaggggatcaaggaaggtgggagttgccagggacccccaggctgaggagggagcctcccagcccccctccactcaccattgtcctgctgcccctccagccccctggtcactgtcacctctgcggctggagggctggagaaaggcccaggagcccagggaacctccaccatgccaggctgccttccctaaaggccggctccttccccccaggcagccagtctgggggtggacctggaggagcagggttctctgggaatctctgggccaagggatgcgctttggggatctgctggaataaagagtaatcggttttccttgcaggaggttgacccgaaacagccctccgtcttcctgcccatgaggatgaggacaggaagccagacccgggagagaaagcccagatcagacagatgggggttgggagggcctagtggctgaaactgccctgcttggggacaatgctcaggcaggaccaatccaaacgagggcactgcttatgtggtccttccggagcatcctccaaggcagagcctggcttcgggccctccctgcaaggacacctgcctccactccctgccagaccaggcctggctgcagaggcggaggggcggcagggctgcctgtctccactgtttggcggtgtttacacgtgtcgctgtcagggtgtctggacagtgggggtcgggggcctcccgggcccagacttccccaggcctattctcacactggtgagagggccctaggggaagggtgtgggctgggtggcggggccaggccagctgagacctacaggaccgtggagcatttaggtctcccacccaactccacccggtcctctgagcatcagttacagagcccaggcagcaggagggcagggcccagccccttatcacccatcctcaaggcaggcaggaaccctgaaggcagcttccaccaggggttcccttagcccccaccctccaaaagccccagaccctgccaggcctcaccctgccagcatcgtggccccagctgacggctcccaagggcaggtgctggcaacacaagcaggagccctcggggcatcccgcagggcacacaccaggtcgccgtgggctccccaagcacctcccagacccagcccttgggtgggtcgtggcccacaaacccccacgccgtgcccatgagatgagccccaccgcccacgtgccctccagccgtggagacctttctcccccttggccatggctcccatggggaggctgcaggccctccctgggctggaccagaggggacagactgtctctcccctgcgacttctgggggcactggagtccttggcctggttaccttcagcatttatagccctccagtgagttatacctcggagttctcacagagcagcatgcgcctgcggcaaagccctcacctccagcccctggaccacctgactgctgcctcccgcctggcgccaaacacggccaccgcctcttttgttaacaggacagttgatccattaaattaaaaatcattcaatagatt

SEQ ID NO: 461273 - DNA, 575 bp, Homo sapiens
ggggatctaagatggttcacagcacagagacctccctcaactggagggcagcagcagctcacccccaccccagaatcagtgttccagaggacagctgggggcagggggttaggaacaatcccactccctcctggaagaggtcctgaccccccaccccacccatctgcctgtacgggtccctctgctatcgactggggcgagttcttttcatgagggccttgcctggtgcctggagggaacagggtgtgggggaaaggtctgtgtgttcccccctcacctcccctgctcagcggtgtggcctctggctctggggaggatcgggaagccccagggtccgtgccttggagtggggggacagccttttctctgccacagcttctgcctttgggggcttacccttcctaggagcagaactgttgtggaggggaagaggacggtgaaggttccgaagggaagggggctgcccccactgaaaacgaagcttccagtcacagccccttcattatttatcaggacccaggggatgaggtggcaggggagggggctgcatggagggagtgccctcaccctcgtcc

SEQ ID NO: 461274 - DNA, 470 bp, Homo sapiens
cccccagccccccagcctgtcgaactgggctctcccagaaggtccccggctccagcccaagcagggagccaggttgggggtgtgggaaggcagaagtcccagggatcctgggggaggctcaggttgtacctgcaggccacagtctcctcgacagacctcggacgaggttgtaagtgttttaaagaaactagagcagcagagaagagagactcagaagcccgtggcacggctttctcggcgtcccctccagcgagggggtctccattgctgcagttgccggttttgtccaaccaggtcaggaggctgcccggccccctccccactctcaaagttgcttgttaaacacagagtcgtaatttgtggctaaatataactagtgtgttctcacggaaagtataattcagggtgctcattgtatgaggttatcaacaagacccatctgggttaaattaaagtgattttcataaagg

SEQ ID NO: 461275 - DNA, 2865 bp, Homo sapiens
gcactgggcctcctgaaaaaagcaattactggctccgcggtttcaaagcggcccaaggccgcttgatgaaaggagataagctggggaccgtttccaggatccccgcgggccgaccggggcagcccgggagccgaggtgcggcggagagcccgcggatcaaaggaatctggagagaaaggggaagcgggcggccggccccggccggccttcccccccgcaggccacgccgacctggggtggggggctgcgggccgcgggcggggactccgggatttcccgcctgcctgagtcggggcctacgccggcgcccgcttcgggcggctcggcccggaggggagctccggagagcccggggctcgcaggtaagcaccggcgctccgcgggccgggccggggacgcaggacaaggcgcggggcccaccccggctggctcgggagtggcggtcgcgcgggcccggctcccgtctccggcgtctcccggctccggcggccgggaccccccgcggccgagcccctggccaggccccaggccggcgccttcggaagcgacgtctggcgggccgcggggcacgagggggagagccgggaagcgtaaatccccgaagcgcgcggagatccgattagcgcgcggctattcattaggctgggggcgattgaattaggtccctgggcgcggtcgccggctggggcacagagacctccctcaactggagggcagcagcagctcacccccaccccagaatcagtgttccagaggacagctgggggcagggggttaggaacaatcccactccctcctggaagaggtcctgaccccccaccccacccatctgcctgtacgggtccctctgctatcgactggggcgagttcttttcatgagggccttgcctggtgcctggagggaacagggtgtgggggaaaggtctgtgtgttcccccctcacctcccctgctcagcggtgtggcctctggctctggggaggatcgggaagccccagggtccgtgccttggagtggggggacagccttttctctgccacagcttctgcctttgggggcttacccttcctaggagcagaactgttgtggaggggaagaggacggtgaaggttccgaagggaagggggctgcccccactgaaaacgaagcttccagtcacagccccttcattatttatcaggacccaggggatgaggtggcaggggagggggctgcatggagggagtgccctcaccctcgtccccagcgcctgccccctcccgaccaggcctgggctgaggcccagggtaagggggctgaggcaggccacagaggagcaagacttgtcaggggccagacctgggtaggaggattgtcctccaggcacacacggcccccagccccccagcctgtcgaactgggctctcccagaaggtccccggctccagcccaagcagggagccaggttgggggtgtgggaaggcagaagtcccagggatcctgggggaggctcaggttgtacctgcaggccacagtctcctcgacagacctcggacgaggttgtaagtgttttaaagaaactagagcagcagagaagagagactcagaagcccgtggcacggctttctcggcgtcccctccagcgagggggtctccattgctgcagttgccggttttgtccaaccaggaggttgacccgaaacagccctccgtcttcctgcccatgaggatgaggacaggaagccagacccgggagagaaagcccagatcagacagatgggggttgggagggcctagtggctgaaactgccctgcttggggacaatgctcaggcaggaccaatccaaacgagggcactgcttatgtggtccttccggagcatcctccaaggcagagcctggcttcgggccctccctgcaaggacacctgcctccactccctgccagaccaggcctggctgcagaggcggaggggcggcagggctgcctgtctccactgtttggcggtgtttacacgtgtcgctgtcagggtgtctggacagtgggggtcgggggcctcccgggcccagacttccccaggcctattctcacactggtgagagggccctaggggaagggtgtgggctgggtggcggggccaggccagctgagacctacaggaccgtggagcatttaggtctcccacccaactccacccggtcctctgagcatcagttacagagcccaggcagcaggagggcagggcccagccccttatcacccatcctcaaggcaggcaggaaccctgaaggcagcttccaccaggggttcccttagcccccaccctccaaaagccccagaccctgccaggcctcaccctgccagcatcgtggccccagctgacggctcccaagggcaggtgctggcaacacaagcaggagccctcggggcatcccgcagggcacacaccaggtcgccgtgggctccccaagcacctcccagacccagcccttgggtgggtcgtggcccacaaacccccacgccgtgcccatgagatgagccccaccgcccacgtgccctccagccgtggagacctttctcccccttggccatggctcccatggggaggctgcaggccctccctgggctggaccagaggggacagactgtctctcccctgcgacttctgggggcactggagtccttggcctggttaccttcagcatttatagccctccagtgagttatacctcggagttctcacagagcagcatgcgcctgcggcaaagccctcacctccagcccctggaccacctgactgctgcctcccgcctggcgccaaacacggccaccgcctcttttgttaacaggacagttgatccattaaattaaaaatcattcaatagatt

SEQ ID NO: 461276 - DNA, 1847 bp, Homo sapiens
gcactgggcctcctgaaaaaagcaattactggctccgcggtttcaaagcggcccaaggccgcttgatgaaaggagataagctggggaccgtttccaggatccccgcgggccgaccggggcagcccgggagccgaggtgcggcggagagcccgcggatcaaaggaatctggagagaaaggggaagcgggcggccggccccggccggccttcccccccgcaggccacgccgacctggggtggggggctgcgggccgcgggcggggactccgggatttcccgcctgcctgagtcggggcctacgccggcgcccgcttcgggcggctcggcccggaggggagctccggagagcccggggctcgcaggtaagcaccggcgctccgcgggccgggccggggacgcaggacaaggcgcggggcccaccccggctggctcgggagtggcggtcgcgcgggcccggctcccgtctccggcgtctcccggctccggcggccgggaccccccgcggccgagcccctggccaggccccaggccggcgccttcggaagcgacgtctggcgggccgcggggcacgagggggagagccgggaagcgtaaatccccgaagcgcgcggagatccgattagcgcgcggctattcattaggctgggggcgattgaattaggtccctgggcgcggtcgccggctggggcacagagacctccctcaactggagggcagcagcagctcacccccaccccagaatcagtgttccagaggacagctgggggcagggggttaggaacaatcccactccctcctggaagaggtcctgaccccccaccccacccatctgcctgtacgggtccctctgctatcgactggggcgagttcttttcatgagggccttgcctggtgcctggagggaacagggtgtgggggaaaggtctgtgtgttcccccctcacctcccctgctcagcggtgtggcctctggctctggggaggatcgggaagccccagggtccgtgccttggagtggggggacagccttttctctgccacagcttctgcctttgggggcttacccttcctaggagcagaactgttgtggaggggaagaggacggtgaaggttccgaagggaagggggctgcccccactgaaaacgaagcttccagtcacagccccttcattatttatcaggacccaggggatgaggtggcaggggagggggctgcatggagggagtgccctcaccctcgtccccagcgcctgccccctcccgaccaggcctgggctgaggcccagggtaagggggctgaggcaggccacagaggagcaagacttgtcaggggccagacctgggtaggaggattgtcctccaggcacacacggcccccagccccccagcctgtcgaactgggctctcccagaaggtccccggctccagcccaagcagggagccaggttgggggtgtgggaaggcagaagtcccagggatcctgggggaggctcaggttgtacctgcaggccacagtctcctcgacagacctcggacgaggttgtaagtgttttaaagaaactagagcagcagagaagagagactcagaagcccgtggcacggctttctcggcgtcccctccagcgagggggtctccattgctgcagttgctggttaccttcagcatttatagccctccagtgagttatacctcggagttctcacagagcagcatgcgcctgcggcaaagccctcacctccagcccctggaccacctgactgctgcctcccgcctggcgccaaacacggccaccgcctcttttgttaacaggacagttgatccattaaattaaaaatcattcaatagatt

SEQ ID NO: 461277 - DNA, 956 bp, Homo sapiens
  misc_feature (10)..(10): n is a, c, g, or t
  misc_feature (12)..(12): n is a, c, g, or t
  misc_feature (14)..(14): n is a, c, g, or t
tcaggatagnangnaggcctgcgccgagtcaagcagcctactgacaaccacctccttctccctatcttcttttctcaataaatatgaagggagctagaaactcaaagcccttgttcactagaagtaaggagccccctgaccccttcaaccaaaaatactcttttgtctttgtctttattcccgcgttcatccccctttgttcagtccaacagggattgggaccatgctgggccactgtcaacactgcccccatagcctctgtgctggcagtagggcggggaccacccctagccacagtggcagtgatgtttgttattgcagatctccttcatattgcagaggaatgtctctcacattctcacattgaactctcccacaaaagacatcagagatatgacattttagtggggccctcatcttgtacgtgcatcaggcccaaaaacttaatttcacctctgactgtgatcaacatattgatgaagactggctatgtggatgctggaagatggggaaaacttgtttcaagctgaacattatccttgccattagcttgcctaaagaggctggattcatctgggcagttttcactgctgcaagttaggcaccttatttcgcaaggtgcaagtagcatggaagagaaaagcaaagttcatagacagaacttccaagaacaaagatctctgaattgggatgaaattctaactgccagatttgctccctgtgtctctcttgatatgttttctacttattatggagtgacagttgttgtggatgggaggattgaaaatgggaagaactaatcaaagatataatgttgtggaaaggactgataagctacacaaacctgtgtcatattattctttttcttggagctcagcatgagagcaggcaataacaggagaataacttcaaaaaaatctttaaaaccagactcattgtcttcattcctaggactt

SEQ ID NO: 461278 - DNA, 1916 bp, Homo sapiens
ggacccattcagtcagaggcagccagcgggacctgcttcaccgagcgcagcgaagccgagacccgggctggcccctctgctgcccccggagcgggccatgccgccgcgggagctgagcgaggccgagccgccccgctccgggccccgacccctcccccgcggcggcgtagcgcgcccccagagctgggcatcaagtgcgtgctggtgggcgacggcgccgtgggcaagagcagcctcatcgtcagctacacctgcaatgggtaccccgcgcgctaccggcccactgcgctggacaccttctctgtgcaagtcctggtggatggagctccggtgcgcattgagctctgggacacagcgggacaggaggattttgaccgacttcgttccctttgctacccggataccgatgtcttcctggcgtgcttcagcgtggtgcagcccagctcctttcaaaacatcacagagaaatggctgcccgagatccgcacgcacaacccccaggcgcctgtgctgctggtgggcacccaggccgacctgagggacgatgtcaacgtactaattcagctggaccaggggggccgggagggccccgtgccccaaccccaggctcagggtctggccgagaagatccgagcctgctgctaccttgagtgctcagccttgacgcagaagaacttgaaggaagtatttgactcggctattctcagtgccattgagcacaaagcccggctggagaagaaactgaatgccaaaggtgtgcgcaccctctcccgctgccgctggaagaagttcttctgcttcgtttgagcagctatggctgcatagcaagtagtaggcaggaggccaaagacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgatcatccctttcctcaaggtcacacagcctagaagctagagcagtgcagagtctgcaaataaaaccttaagtctgtgaaggcgtgcgttgtctctgtcatttcctggagcccactcctccctcagaaccctcctcaaggcctaactgcctggctagagacagattggggaccaaaggactgaggctagattgaaaggtgggggctggactgggggtgggggcagtgtaatgggaactggactgtggggatgccccatttctcctcatgataaccagctttcaatacctccctcctccagaacagatgcttacctgtatcagtgtcttcactgctcccttggcacactgaggacactgggcgttctgcgactgactcagcctgcatcttcccagctaaatgaagagagagagagagccacgtttaagttccttttgctcccacaaggtctggggctcaggcaatgtttgctgctgaccctgaaatgcttaggaataaaaagccagccagtgagccctggagaggctgggaggattaagtttagctccagatttggagcttgaagactgaggcctaatgtcaacagcttgctggaaaggacctctaaggctctggccccaagcctgtgcaggacaagagggattcgcttctgcttccgaatccactggttctctttggttctgtctctttctctagaatatggtacctacttttctggggtagtttttttgtttttatctctctgtctgtttccttggcctcttttcccttttctctgctcttttaaattatatttaaaggaatatttattatatgaattggataaaattatatgtttcttacatatacattcttacatatgtcctt

SEQ ID NO: 461279 - DNA, 2437 bp, Homo sapiens
ggacccattcagtcagaggcagccagcgggacctgcttcaccgagcgcagcgaagccgagacccgggctggcccctctgctgcccccggagcgggccatgccgccgcgggagctgagcgaggccgagccgccccgctccgggccccgacccctcccccgcggcggcgtagcgcgcccccagagctgggcatcaagtgcgtgctggtgggcgacggcgccgtgggcaagagcagcctcatcgtcagctacacctgcaatgggtaccccgcgcgctaccggcccactgcgctggacaccttctctgtgcaagtcctggtggatggagctccggtgcgcattgagctctgggacacagcgggacaggaggattttgaccgacttcgttccctttgctacccggataccgatgtcttcctggcgtgcttcagcgtggtgcagcccagctcctttcaaaacatcacagagaaatggctgcccgagatccgcacgcacaacccccaggcgcctgtgctgctggtgggcacccaggccgacctgagggacgatgtcaacgtactaattcagctggaccaggggggccgggagggccccgtgccccaaccccaggctcagggtctggccgagaagatccgagcctgctgctaccttgagtgctcagccttgacgcagaagaacttgaaggaagtatttgactcggctattctcagtgccattgagcacaaagcccggctggagaagaaactgaatgccaaaggtgtgcgcaccctctcccgctgccgctggaagaagttcttctgcttcgtttgagcagctatggctgcatagcaagtagtaggcaggaggccaaagacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggggctggcccctgggaagaactgggtctctgggctccctaggcactgcccaaactggctgagccaggagtggggcaggaagtgagagtcaaggcccagcaaaaggagggggaggagctgcaaattagaacctgaaggaggaccgggttggggatcatccctttcctcaaggtcacacagcctagaagctagagcagtgcagagtctgcaaataaaaccttaagtctgtgaaggcgtgcgttgtctctgtcatttcctggagcccactcctccctcagaaccctcctcaaggcctaactgcctggctagagacagattggggaccaaaggactgaggctagattgaaaggtgggggctggactgggggtgggggcagtgtaatgggaactggactgtggggatgccccatttctcctcatgataaccagctttcaatacctccctcctccagaacagatgcttacctgtatcagtgtcttcactgctcccttggcacactgaggacactgggcgttctgcgactgactcagcctgcatcttcccagctaaatgaagagagagagagagccacgtttaagttccttttgctcccacaaggtctggggctcaggcaatgtttgctgctgaccctgaaatgcttaggaataaaaagccagccagtgagccctggagaggctgggaggattaagtttagctccagatttggagcttgaagactgaggcctaatgtcaacagcttgctggaaaggacctctaaggctctggccccaagcctgtgcaggacaagagggattcgcttctgcttccgaatccactggttctctttggttctgtctctttctctagaatatggtacctacttttctggggtagtttttttgtttttatctctctgtctgtttccttggcctcttttcccttttctctgctcttttaaattatatttaaaggaatatttattatatgaattggataaaattatatgtttcttacatatacattcttacatatgtcctt

SEQ ID NO: 461280 - DNA, 3209 bp, Homo sapiens
ttcaagatcttttgaaaatcagccgaaagatgaggaaccgcctgccaccaagaggcactgatttcactgggagcatccctaagttggtttggtccctccagtgtataacgctctgaggctaccctgatagtcctcagagacccaaagcccttccagaacaccctgggaatcctctctcaacacaccccaccaggcagaaaacttaaatcggatcttaaagcagaaaacaaattaaactggcttcaataataaggggattatctcatgtaaaatgagtccacaagcggagcagccactggagaggctcaaagatgcctaggacctaggcgtccccttttttctcagccccagctcacttccttctctgtgctgacgctgctgtagccattctaagcatcgtgttcaggcaggatctccagaggcagaaaaggataatgagaatctccctagaggtggaacttcccaatagggaagaaggagacttgctggtggtatacacaggtctaacatttgccaactatggaaatggaggacaagccacaggtcaagctagcctagctatactgaagatagttgtgctttctgaggatgggactgaatgcaaacgagtgatattctataagaaaaagagatgtacgttacttttgacaaacttcatctgtacttatttcaggaaaaacaaaattaagcagcgaagctctttagagcaacagaggcttttaaagagagttctctcagatacaagcagaataataacagtcaaaagaatccagttgtattcacatttggacacagaacaaataaaaagggattggcaatgtagttccaagtggaaaacatcacaaagaagaaagctagagaatatacatttctggagagattctggcaaaagctaagatattctgcttcccatgatctaacagataagatataattttgcttctcctttccattttcaaaatacttcctcatttgtaatcatttattgccaataaatgggatctatccatctatctatatatttatttataaacatgtagccaatcacatagggtgaggttgaacaaggaaggctgacatagaaacacagactaagagagagaaataggtgacaaaatgcattagaggagaggattacccttgggtttgttttcatcattttttttgtctgttgactaaaataacatttttctgtcttgaatataagaccttgtctgggggtcacagctgtatttctttctagtttaagtgacatattcacttttatttcttattttaagttgacctggaatcttataacactcctatttacaggaaattgtaaaatcaaacacagaaagctcttttgtttgctattgatacaaacttattcaaagcatcatttggtggcattttaaacatccagttattatttttaatataactgtatatttttaatataactctatatttttaataatatgctccttggaaatagatgctttttttttttcaagtttggaaacatacaagatatttacctggaactcttctgaaggatcttggttttcaatttgataatgtactgaatcatactgggcatctgcacactactgacaaaagaaaacattagagcactctcatttcaggatagttctgactattgcccttcagagacattttggagacacaataatggtgtctaataatttcagccaaactaggtatttatcacagcttcaaacaggcagtaattcacttatatttattttctcagaatgtaacactggtctgaattaaacattatgatacatacctgtactgctataaactattttttcaaattttcctagtcaagatttctttctcaaagaagaaaattagataggtgcagcacaccaaatgagatgaactttgtcctcaaagaaaattggtttttccttttcaatttcatttcaaagagatctgacaagtgtggctttgaacaaactttaacagcacaatatcctttgttgtcaaacgttcatgtagagacaacttaaatgcaaagtggataaggttacagaataagtccatgcccaatttaattacagcattttgattaacacagattgtaagtagtttgaactaagaattttaagttgttcatcttgaatattacaaaggctaaccagagacgaagtataactttaactcagaaactgccagaaaacactctgattaaccaatttagatgtactatccaattaaggatctaaatatctttggatcacagaaattcatgtttattgataagataaaatatttattacccagagagctgaattagcaaagagaacagctctaatcaggtactaactttcagaaaaaagaagaatgttggttgaaattaaaagtgtgatacttacgagcaaacctggcttgtttattcaaaggttatgcttcttgccagcaaagtcagtatctttgaaagcttggagttaataaagtctgtggctaagtttctaaatgggttcaatagataatgactgtccatagcaatagctaattgagaataatgactgggcaagaaagggcgggcatagagcagagatggaagaaaacttccctgaagtaaaggcctgaaaatacctgcaagggcaatggggaaaaaccccaaagcctttgtatttactgaatggtcattagctgcccaaattttttatttttttctctttggatgaatgtaatgttgtttctcttaaaaatataaggaaggcaaggaaacattagaggctcttgtaatgtattttctagtacttggaaaaatgcctatacagagtaaacaatcaatggatttagaacttctccatcttaaaaagcatgaaaatggaggctattccaatttttctttgtaagatttaattttctattaatttgtttttggggttatttgaggcatctcaaatagatataaaatcaggtctaagctatgcaaaggttgagagtaacagtaaggtgattgttatttttcatttgtaaaaattttaaatcattgtaaatacaaagttttgtactcatggattttaataggtagaatataatgtttgatatagtaaagttgtatgaaagagcatgctatattttacccatttaatgttatcaaagacaacgaagtttcaataccttttcaaaatgggattagtcagatagaaccacttgcctgttggcaattttatttaaataattat

SEQ ID NO: 461281 - DNA, 4124 bp, Homo sapiens
ccaaggctgtaggagttctggagctgctggctggagaggagggtggacgaagctctctccagaaagacatcctgagaggacttggcaggcctgaacatgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattgctactggtgtctgagactcatcactgtgtggagctggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttacaagttcccccatctacagaactgcgtcactgtaggggagtcccttcttccagaaactctggagaactggagggcccagacaggactggacatccgagaatcctatggccagacagaaacgggattgacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggtgagaaactgtgctcctcctcctctgttccccagtgaggatgggagcactaaacgggatgagggaggccaaatggcaggggatttaggctttgcaggcacaatgactctgtctttctgtggtcaccaggacaatcccgacaagacagcagccaacattcgaggagacttttggctccttggagaccggggaatcaaagatgaagatgggtatttccagtttatgggacgggcagatgatatcattaactccagcgggtaccggattggaccctcggaggtagagaatgcactgatggagcaccctgctgtggttgagacggctgtgatcagcagcccagaccccgtccgaggagaggtgatggggaagcagtagcctgggggtgaacacatatgaacacaagggcagtgtagtgatggacaccccaagtatcctaacttgataattaccatatttgcgtgtaacaaaatgtcacttgtacccaatacatatgtacaaatattatgaaatgataaaaacttttagaaagtaaagtgcttggttgggaggctgaggcagatggatcacgaggtcaggagtccaagaccagcctggccaagatggtgaaaccccatctctactaaaaatacaaaaattggccaggcacggtggcaggcatctgtaatcccagctactcaagaggctgcggcaggagaatcacatgaacccggggggcggagtttgcagtgagccgagatcgtgcccctgcactctagcctgggtgacagagtgagactctgtctcaaaaaaaaaaaaaaaaaaaaagaaagaaagaaaaagaaaaaaagaaagtgaagtgcttggaacaaggcctagcacatagtaagtactatataatgtctattttgatgaggctggaaggattctatcctgctgtttggtatttgaatcagagtctgattcccgaccagaagaacagaggagggatttgagccaaaggacagagcccgtgtgccacagagttcgcagtgaaaataaagggaaaaagaaagacccctataaagccaggcttatagaaataggctcagatggggtctagtggactttgatgtgtgtgtaggaaaatattaaggtgggatgtgtggatcagtgtcctagcacattcccgcagggtgtaagcctggcactatcatacctctggtacgtacagaatacatcatacagaaaattatgggaaccactgagcagtgaggccatgggggaacccctgctgagaaaatcctgtgtgcccagctctgagctagccctgctgtatatgatttcattttatttaccgtaagttaaatttggcaattttatccccactttacagatgggaacactgaagtttggagaagttaacacattgtttagggttatggttttcagtctatttttctcttttctccccctgtatcttctttctccttatctgtctctattgttattggagtatgaggtgagcctagtctcaatcttttgtccacctgctcctccaataaatgacttcagagagagctgtaacctcattcatgtccccagttttctccttttcccttgacctggatcaccgggggtgcaaatgaggagatacaagggtgatggaagtcttaatgccaatttcacattattccaggagatgactacacactctaatcccttctctctggccttcatcttttttgcaggtggtgaaggcatttgtggtcctggccttgcagttcctgtcccatgacccagaacagctcaccaaggagctgcagcagcatgtgaagtcagtgacagccccatacaagtacccaagaaagatagagtttgtcttgaacctgcccaagactgtcacagggaaaattcaacgagccaagcttcgagacaaggagtggaagatgtccggaaaagcccgtgcgcagtgagacatctaagagacattcatttggattcccctcttctttctctttcttttccctttgggcccttggccttcctatgatgatatgagattctttatggaagaacatgaatataagttttgtcttgccttggttattagcacaaaactttaccatgttagatgttgaaagaagaaagggaaggaatgagagagagtgaaaaggagagggtaacagaaaaaaaggaaagaaaagtaagtcagggaaatattaaaactgcaagggaaagcaattgaaaaagaaataaagtagggaaagaaggagagaggaagcaagggaaggaggaagaaaggaaagaggagatgaaagggggagaaaagatagaagaaaaataattgaagggagaatcagaaaaataaagagaagaaaggaaagaaataaagagagaaagagaaagaagaaagagcaaaagaacacaagaaagaaagagagggagaaagagagggagaaagggagagaaaaaaattgtaaaaataaaaatagtaaaagaaactgataaagaaaagtaatggaagacaggaagaaaagaagagaaggaagtaaagaggaaaacttataaatattcccacagatagacaaagtcaagcataaaactggagcttgagaaggaaatgaaaggccgtggcaccttcttataccctagaagaagacctccatacaggaagacttgtgtgtggggttgggacattagaatcatccacaagtcaccccaaaccttggaactgtcagggtcagaggggaaccaccatttattaagcatttgccatgtgccaggcactaacccagatgcattataaataccacgttgtttcacctgtgtgtggcatctacagaccttagatcatagctgtgagaacaacgtaagcactgccaaagttatcagctacccatatctcatgtttttgatgttatctactcttcctagaatcaaatattaaaataattttaaaaccaagatcctgacaatagtctttgggaaaaacaaagaaaggcagggatgaggtaagtgtac

SEQ ID NO: 461282 - DNA, 316 bp, Homo sapiens
agttctgctgggaaggttggaacagaaaaagggggcaggagccaagggagacatagagtccaaggagagttcttaaggatggaaaatgctgagaggaagaaagaagaataaactgatgctacagaagaaggaggaggtaattacaggagcaaagtccatgagaaggctgcaggcaatagagtccagaacaaaagtgcggagctcgctggcctgagagagcaggagggacagttcattcattgaaaaatggacgaggaaagggtggggcggtgacgtagagggtgatggtagatgtggcgggttttaggggctcttt

SEQ ID NO: 461283 - DNA, 2131 bp, Homo sapiens
agttctgctgggaaggttggaacagaaaaagggggcaggagccaagggagacatagagtccaaggagagttcttaaggatggaaaatgctgagaggaagaaagaagaataaactgatgctacagaagaaggaggaggtaattacaggagcaaagtccatgagaaggctgcaggcaatagagtccagaacaaaagtgcggagctcgctggcctgagagagcaggagggacagttcattcattgaaaaatggacgaggaaagggtggccatcaacgtggggctcacgtcactggatctgagctggaataacttccacacaaggggagctgtggccttgtgcaatggtctccggggtaatgtgaccctgacaaagctggatctctccatgaatggctttgggaatgaggtggctctggccctaggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccccactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatggtggcagggaggagagcaagaggtggctgaaatctcgatggacagatgctgtggcaggggctgggcacaagcaaataaagtctggcttggttctgggtgtcttgggctgctggtggtgtgcccgtcaccagggggccaccttctgcttttagtgaccaccaggggacatgtcaatgcagcctcattaagagctgcacagacaaattgggaacgtgatggggttgctaggcagcagggaaagagcctcagggagcaggtcagagcatgagggcagttgtcacagtgattagaacctgagtccaggggagacttccttggtgggaggcagtgacagggggaacagatgctgagggaatgagggcaggggcctttaaaaagcaaagaaatgctgtggggtcacaaggagggagccaggacaggagaccaagagagtgggcatctcatcctggccacatgaccttggatccccagtggctccccttgaaaatggagcagctgaaataaagccttcccagtccggtctaggagtctatcattctgcatttcacctttaaattccttgagaaactggggagacaggaacagcttagcgaaggaataaaaggaatagccaagaacagcattcactgattaagtgggtggaacaggcacctttgggagttttgattgatcttaccagacaccattgtagattagcaaggcaggaactttcttgtgcccctctgcagccccatgtagtgcttggcacatagtagatgctcaataaacacctgtgaaatgaacgagcacattcaccggtgattgtttggggtaagtggtggaaagttgggaaagtttagggggcgagggaaggctgatatttggtaacccacgctttggcgcagcagcgaagggtctaggaaccaagtcactatctcttgtgtttcacttggcttcaccaagggtggaggtgaacaccaagacccctctgcacatgcagcggaattattggaaataatttatgtccccactcatgtgccgtattccccccctttctcttccttattaaaatcttagcctttatgaggttt

SEQ ID NO: 461284 - DNA, 1338 bp, Homo sapiens
cgcctcctgcgtggaaaagagaaggaagcccgaggtggtggcgctgcgtctctcagttgcagtgtgaggtatgagacaccacacctagccctgaagctgctcttggttgggggtcatcccacacctaagaaagaaagatgatggctctaaagaagatgaaaaagtcattggtgtcaatcaactctaggctccaactcattatgaaaggcagaaagtaggctgggcaccgtggctcacgcctgtaatcccagcactttgggaggccgaggcaggtggatcatgaggtcaagagatcgaaaccatcctggccaatgtggtgaaacaccatctccactaaaaatacaaaaataagctgggcggggtgaaggggcggccgggcagaggcgcccccccacctcccggatggggcggcagccaggcggaggcgccccccacctccctccctgacggggtggctggccgggcaggggttgccccccccacctcccggacggggtggctgccaggcggaggggctcctcacttgtcagacggggcggctgccgggcagaggggctcctcacttctcagacggggtggccgggcagagatgctcctcacctcccagacggggtcgcggccgggcagaggcgctcctcacatcccagatggggtggcggggcagaggcgctccccacatctcagacgatgggcggccgggcagagacgctcctcacttcctagacgggatggcggccgggaagaggcgctcctcacttcccagactgggcagccgggcagaggggctcctcacatcccagacgatgggcggccaggcagagacgctcctcacttcccagatgggtttggagggctcagaggaagacaagaagatgtgggaaagtttggaactaactagagacttgttcaatggctttgacgatagtgatatggacaatgaagtccaggctgaggtggtctcagatggagacaagttccagtaccttcttcctcagttccatctaagatattgtcagaatggcatttaccatccatatttttaccagtattctgatcacaaccacctaactaatccctatgatttagaatctctcaaaagctcagcttcttctgagccctcactagaattgcctttaaaactccattcatggaaatctaagctctttctaacctgcttctccaaattcttacagcctctacccattactcagtttgaaagtcacttgcttattttggggtatttattataacaacaatcctacttctaataccaattttctcatttagtccattttgggatgcaataacaggatgcctgagactaaggaatttataaag

SEQ ID NO: 461285 - DNA, 1172 bp, Homo sapiens
ccccaggtggaggtgcttaccagccccgcgccgtgcgcccgcactcctcagcccttgggcggttgatgggaccaggcgccttggagcaggaggcggcgttcgtccgggagactcaggccgcgcaggagcccacggcgtcgtcggggcggggagactcaggcatggcaggctacaggtcccaagccctgccccgcgggggagcagctaaggcccagcgagaaatcgagcgcagcgccgctgctggccaggatgctaagcccctcactaccaggggccggcagggccggctggccgctccgagtgcgcggcccgccaagcccacgcccacccggaactctagctggcccgcaagcgcagcacgcagccccggttcccgcccgtgcctctccctccacacctccctgcaggctgagggagccggctccggtctcggccatcccaggaaggggctcccacagtgcagcggcgggctgaagggctcctcaagcgtggccagagtgggcgccaaggccgaggaggcgccaagagggagcgagggctgtgaggactgacagcacgctgtcacctcgtctctacttaggtgaatgatgcctttggcctgcttatgtcttccatagccacaatgaatacagttgcagaaactctcactctttatggaaaatagaagggaatatgtacaagaaacaattactgtatgcagataaggcagatggtgtctttgacatttcatcaaggcagcagcatctgaaagtttttcaagaaactgccaaactgttctccagagtatttgtaccattttacgtttccaccagcaatatacaagtggatctcactctgtcacccaagctggagtgcactggcatgatattggctcactgcaacctctgccttctgggttcaggtgattctcctacctcagcctccccagtagctggaactacaggcatgcaccaatttttgtatttttagtagagacggggtttttccatgatgcccaggctgttggcttttactttgcctttccataatcatcttgtatgtgtgagatacatacatatatatgtgtatatatgtatacataattgtatatgtctatatatataaccttattatatataattttataatataatcttcatctaattttgatggaaattacattaaacttgtgt

SEQ ID NO: 461286 - DNA, 2227 bp, Homo sapiens
gtcttttaccattttattccaaagcaaatagatgaagtctggcgtgaaatgagatggatcatggatgctctacagtatgcaagatacaaacaaccagtttctggcttgcccatcactaagctgatagacccctcagatgagcagagcctaaagaagatcaattctacatcatcatcacatatagactgtcttccatccccacccccatccccagagatgcacagaagaaagacagtgagtgattcacagccctgctctgatgaagaagcctgctcagaagtcttcctccccaccaacagtgactacgactccagcgatgccctgagccccagagacctggacctggtctacctatcatctcacgacattgcgcagcagacccttagcggcctaagcggcagcgcccccgacgtcctgcaagtgcacgacgtgaaaacccctctggggccgggccaggatccccagggcgagggcccaaatcccgatcactcatgtgccgagtttctccatagcctgaccctcacggggttcacacccaagaaccacgccaagactgtgtccggtgggcggcccccgctaggcttcctgggaaagcggaagccaggcaagcacccccactatggcggcttcagccgccatcatcgctggttgcgcatccacagcgagacccagtcgctatcgctctctgagggcatttatacacagcacctgtcccaggcctgtggtctggcccaggagcccaaggaggccaagcgggccggccctgcccttgatgatcccaggggcctaactctggcccacgctgccagccttcctgaggagcggaacagcagtctccaggacgcgaggccttccgtccgccgcctctacgtggagccctacgcagcggccgtggtggcccaggacgaaaaaccatgggcaagcttgagcccgccctctggaggccgcatcaccctgcccagccccactggccccgatgtgagtcaggagggccccaccgcctctcccatgtcagaaatactcagcagcatgctttagggaggcccatcccggctgtccacccctccatggctgctacctgcgttttacatcacccttacccccatcctgccccactgtgtacccactcattttcaagcgttttgaatgttataaatacaaaggttacaagttcaaggtcctctttttttggaacagagtggtgggtggaggccagagttgccagtgccattcccacttcagcctagaaagggcatgggggagttgtgtcaacatggaatacgacatacagtgactcaaacatgccaccctgttggtggcacctatgactgaagctggccatcccaaagagagaccctctgttctgcagctggttctgtaatctgacccctagtttagggctctttcatgaatttgtgattgatgaagagaagttctataaatgaaaataagattagcatcatttctccctccattccaaaccttaagaagagtttgagggaaagacaccaggttgtgtctctagggcacggggtcaggtgggcttgaccttggttccctttctccaagagaaggtatgtctgcaacgcatttaagttgcctagttatgtcaacaagacacagaattcactggcttctgaaaatgtacacatgttaggaaggtgatgacatttttctacagctctctcaacttcgtatgtagcagagctacagcaaagagtgtgtatttcttggtatatgtgcttattaagctatcacataccaattagagaaggtagctgtagattaacaaaggaacactctctgagaatttaaactgttgcatggtcactttacaaagtctaaatatttttccagatgatttaatgaagcaaacctggacttttttcttcaaggtcgtatcttcaaggaaatttttaaaatagctatttggaaagcaatggtatctcttcataggtaatagggtgagcaaggaaaaaaactgttttctttgctggtcacctctcataagatgttcaaacacatggcttatgactgttaagctaaacttcaatgcggccttacaaacaacaagggtagtgtatttgaaaccatgttgtaccacttggaaacttattctaagatcttaattcagactttttctgaggtgttgaactttgccattagcaaaaagtatttttagaaaaatccattgactgtttatgaagcactgattttgccatatttc

SEQ ID NO: 461287 - DNA, 2248 bp, Homo sapiens
gagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacaggtctggcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaaggttcggatgatggctgggggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaatagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttggggctgaggtccatttgtatgcacacaaagaaaagagtttcttcctttcgaggaaataaaattggcctgaaagacgtcattactctacggaggcatgtggaaacaaaagttagagctaaaatccgtaagaggaagctgctcgggaggctgaggcaggagaatcacttgaacccgggaggc

SEQ ID NO: 461288 - DNA, 975 bp, Homo sapiens
ctcggcggacagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgagccgagggctgccggagaaccctgcaggtgtcactcgggacgcggaagtgcgcttgccgaggtttgccttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggtaagaaattacaatatccatagtatttaataaaatgggaatgtataccgggctttgagttaaagaggaccgtgaactcatcatccattggtctctctagggcggccatcaaagtcctaaatcccaaacctaatggcctttactgggaactcacctcatttgaagtttcctgacacctttcaaatctgcctcttcttcttaaaacaccctcctgctctgtgacactagctcttctcctttctctcggaaaatttcaccacagtgtcatctcttctgtggctgtctccttgctttgtcctaaa

SEQ ID NO: 461289 - DNA, 3484 bp, Homo sapiens
  misc_feature (1144)..(1144): n is a, c, g, or t
  misc_feature (1146)..(1146): n is a, c, g, or t
  misc_feature (1148)..(1148): n is a, c, g, or t
  misc_feature (1156)..(1156): n is a, c, g, or t
ctcggcggacagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgaggtccgcagggccgcggggaagccgagggctgccggagaaccctgcaggtgtcactcgggacgcggaagtgcgcttgccgaggtttgccttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagaatggctatgaccgcgtttgccagtacaacactgatgatgtttttagngntnccaaggtnagccagggtgccgttccttttcactattgtgccattctctgttctacggtccatgttgtcaaaagtggttcgttcgactgaacaagctgtcacttgccagactgaggaacagataagaaggttttctttacctttcaaaaggctcttgcaggaagcattgcttgttaggagccatcctgtgctttcaggtgtcacagattagcatggggttggagggtgggagacagcatcctgaagagcaggggtaggtgtggctttgcctggggctgtggcagagaggagagacatgcagttatcaaaagagtcagctgcactgtctttttagctttgccctgtggacactggaactcagctatttggagtttccaacatctctcacatcaagtccaaggagaacctttcccttagtttcctcagctgcagaatgggctgctgacttctcagggactttgagggaataactttcatttcattcacccagcagtgccctcatgtttactgttttcaatgagtaacagttgtctccattagtttgtgtttgttgttttgtaattctgccttttttttttcctctctctctatccctactccaaacaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttattttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtactccttaaatttgaatccgtcaacacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaactaaatgactacaaaattttatttttacttgtaaaaatcatttagagctatatatttaatgccttatgagag

SEQ ID NO: 461290 - DNA, 464 bp, Homo sapiens
gagaatgttttctgcagaaacagcctggggtttcaggaaggcaggcccagttcaggggtgccttgggagcaaaggtcctgtcattccaacactaaggaattagacctttacgagaagcacagttttgtcttcagtttcctctccccccacccggaatggcctgagccgaagccagctccctccgagaagtcattaccgcctgacttgcgtttgatatttagacaccttggtcacaacatcttgcattctctcgggatgctgatttctaactgctctttggcctttcctgcattggtcctcctcaggcaggggatccctgctcttctatattaatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461291 - DNA, 850 bp, Homo sapiens
cttcccagccttcagaaattgccggtctgggagttgggggcaaggagaagatcctgcaacccagtgattccatggaaagcagaaagaaggacataaagaaacggatacttggtgacatctttgactcactggatcaaaccttgcctgaagctcacatttctgaaatttccagatacaagaacaaatacttcctctttattgttttactagatttgagacaagctttaagtttctcagactcttcctcttcctaacagatttatcagaagctgaaagctctgatcttgttgggatgcggatcgtgtcaggagaaggcttactttgcacgcttttcttagtctggttgcctaactcaagaacctcggcatggctctgttacttctctactcagacaagcatccctgcagacactcactaggctaactctgtctttatttttagaattagacctttacgagaagcacagttttgtcttcagtttcctctccccccacccggaatggcctgagccgaagccagctccctccgagaagtcattaccgcctgacttgcgtttgatatttagacaccttggtcacaacatcttgcattctctcgggatgctgatttctaactgctctttggcctttcctgcattggtcctcctcaggcaggggatccctgctcttctatattagtgagaaaaccaaggctcagagaaactgtggattttctaaggatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461292 - DNA, 374 bp, Homo sapiens
aggagaagatcctgacaggaacataatctcatgcaatttattgcagtcctctccccccacccggaatggcctgagccgaagccagctccctccgagaagtcattaccgcctgacttgcgtttgatatttagacaccttggtcacaacatcttgcattctctcgggatgctgatttctaactgctctttggcctttcctgcattggtcctcctcaggcaggggatccctgctcttctatattaatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461293 - DNA, 678 bp, Homo sapiens
cttcccagccttcagaaattgccggtctgggagttgggggcaaggagaagatcctgcaacccagtgattccatggaaagcagaaagaaggacataaagaaacggatacttggtgacatctttgactcactggatcaaaccttgcctgaagctcacatttctgaaatttccagatacaagaacaaatacttcctctttattgttttactagatttgagacaagctttaagtttctcagactcttcctcttcctaacagatttatcagaagctgaaagctctgatcttgttgggatgcggatcgtgtcaggagaaggcttactttgcacgcttttcttagtctggttgcctaactcaagaacctcggcatggctctgttacttctctactcagacaagcatccctgcagacactcactaggctaactctgtctttatttttagaattagacctttacgagaagcacagttttgtcttcagtttcctctccccccacccggaatggcctgagccgaagccagctccctccgagaagtcattaccgcctgatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461294 - DNA, 363 bp, Homo sapiens
actcatgttgaaatttgatcccccatgtagcagtgttgggaggtggggttgggtgggaggtgtttgtgtcatcggggcagatccctcatgaatagattaatgccatcttgtgagggtgagcatgttctcagtcttacaggaatggattagttaccctgagaacaggttgttacaaagagtttggcttcctcggttgctttctctgtttctctctcatcatgtgatctctttgcagatgctggctccccgtcccctgtccaccatgagtcaaagcaatgtgagtccctcaccagatgcaactgcccagtcttggactttccagcgaccagaatcatgagccaaataaacctcttttctttatga

SEQ ID NO: 461295 - DNA, 424 bp, Homo sapiens
cttcccagccttcagaaattgccggtctgggagttgggggcaaggagaagatcctggaattagacctttacgagaagcacagttttgtcttcagtttcctctccccccacccggaatggcctgagccgaagccagctccctccgagaagtcattaccgcctgacttgcgtttgatatttagacaccttggtcacaacatcttgcattctctcgggatgctgatttctaactgctctttggcctttcctgcattggtcctcctcaggcaggggatccctgctcttctatattaatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461296 - DNA, 1047 bp, Homo sapiens
aagtactgcctggttactgctaatgctcattcaaggcccaagggctcttcagccagcttgtggtgaatgctgccaaacctgggactctcccttcaaggcagtgggctcccctctggcccagggcaggtccagaaatgccatccaagagctgaggcctggaatttgggaccccaacagcatagttggtgctctaccccactgtgaccaagctagtacctacgctgatttttggttcttaagaaggtgtttttgtcaacccagtgattccatggaaagcagaaagaaggacataaagaaacggatacttggtgacatctttgactcactggatcaaaccttgcctgaagctcacatttctgaaatttccagatacaagaacaaatacttcctctttattgttttactagatttgagacaagctttaagtttctcagactcttcctcttcctaacagatttatcagaagctgaaagctctgatcttgttgggatgcggatcgtgtcaggagaaggcttactttgcacgcttttcttagtctggttgcctaactcaagaacctcggcatggctctgttacttctctactcagacaagcatccctgcagacactcactaggctaactctgtctttatttttagaattagacctttacgagaagcacagttttgtcttcagtttcctctccccccacccggaatggcctgagccgaagccagctccctccgagaagtcattaccgcctgacttgcgtttgatatttagacaccttggtcacaacatcttgcattctctcgggatgctgatttctaactgctctttggcctttcctgcattggtcctcctcaggcaggggatccctgctcttctatattagtgagaaaaccaaggctcagagaaactgtggattttctaaggatgctggctccccgtcccctgtccaccatgagtcaaagcaatgtgagtccctcaccagatgcaactgcccagtcttggactttccagcgaccagaatcatgagccaaataaacctcttttctttatgaatta

SEQ ID NO: 461297 - DNA, 6186 bp, Homo sapiens
ctgggcctggggagcagaggtgagaaccctgcatggtctggtagcaaggagccgggctgttctcatgtgttcttggtggagctggtttgggtccacatcagcgagcctgagctccatccctaaatgcagaatcaagtgggcctgccttgctgccgccgccgccgctgctgccgctgccggagcaggaagtggtgggtcccagatgtgactcactctcattaggtagcgtggaaggagccttcggatgggtgagcctgggcgcgtctgaggaagggcaggcgggggccgggccacctccctgcagaccctggccggctgctggggccggggaggagagccaggggagcctggttgattgcttagtcagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggtcctgtctggccaccccaactggcgaaggcctcaggcatgtgttcttggatcggggtgggggtctcaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacaggaaccagagtttcctggcccctggcccttctgcatggccacatgatggagcacctgttgtatggtgccctggcggggtcagtggagtcggtggaagggaaggagatgactgtgggtgtcctggtccccatgccaatcccgggggtgtagccgaagatgccttagactggggctcgggtctgccctctgcctctggcttggctgctggccagctgggccatgctgggccatgctgggtcctcactcgccctctctgggcctcagtgggacccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgaggggctcagctccacgagcccccatctcaccgcagctgcccccgcccacaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcagcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagaggtgaagtggtgtaaggtccggtttcttcccatccaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggtgttcttcccgcctctgaagacaacaggtctctcttccttttcaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461298 - DNA, 5450 bp, Homo sapiens
ctgggcctggggagcagaggtgagaaccctgcatggtctggtagcaaggagccgggctgttctcatgtgttcttggtggagctggtttgggtccacatcagcgagcctgagctccatccctaaatgcagaatcaagtgggcctgccttgctgccgccgccgccgctgctgccgctgccggagcaggaagtggtgggtcccagatgtgactcactctcattaggtagcgtggaaggagccttcggatgggtgagcctgggcgcgtctgaggaagggcaggcgggggccgggccacctccctgcagaccctggccggctgctggggccggggaggagagccaggggagcctggttgattgcttagtcagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggtcctgtctggccaccccaactggcgaaggcctcaggcatgtgttcttggatcggggtgggggtctcaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacaggaaccagagtttcctggcccctggcccttctgcatggccacatgatggagcacctgttgtatggtgccctggcggggtcagtggagtcggtggaagggaaggagatgactgtgggtgtcctggtccccatgccaatcccgggggtgtagccgaagatgccttagactggggctcgggtctgccctctgcctctggcttggctgctggccagctgggccatgctgggccatgctgggtcctcactcgccctctctgggcctcagtgggacccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgaggggctcagctccacgagcccccatctcaccgcagctgcccccgcccacaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcagcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagaggtgaagtggtgtaaggtccggtttcttcccatccaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggtgttcttcccgcctctgaagacaacaggtctctcttccttttcaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctgtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaagaaaggaatggagtctgtttagagacaacttgactacctgcgacctatgagggatcctctagatcacc

SEQ ID NO: 461299 - DNA, 4046 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461300 - DNA, 2712 bp, Homo sapiens
cccgcctggggggaacatacattacacagaatataaaggtacacatttctttttcattctgttttatgcagcaaataattcgttggcatcttctctgtgatgggcagcttgctaagattagactcaggccccttagcttcatttccaactaagcccacgctatcaaccaagccaaacagaggaaatcagtttgggttgaattctttgctggagacaaagaatctacattcctgtgtagataatgctgtgtttgctctgtgcagacacagatggaagggaagagggagacagtgtggggacggagacaacaggaagagcaggagccgccaagggccatgtcctcaccatgcttagtcatgcgctcagctggcagggcagccatgagacgtgtgtgcgagaggcggcgatgggtggagggaaccccacacccttcctgagaagcaggggcagcctggctgcggctatggagtggcggctgcttcaccgcttccttcttgcctgcagctcctactgaagcccaagttcagcggcgtggagaagatcaagaccatcggcagcacgtacatggcagctgcagggctcagcgtcgcctcagggcacgagaaccaggtactcaagcccaagaggtgaaattcagctgactgtcctcacttaaaggtgacctgtcaccttacttaaagggtgtgcccttatctcgtcctgggggaggggcacaggtacttgtagggctcagccaggattttagtggtggggatcctcaacaagagtggcgcgccagggcccactaggtctgggggctctggagatgcaaggatctgacccacagcctgtcccgcaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461301 - DNA, 2234 bp, Homo sapiens
accattgagagttttaataatacgtaactacagaaaatggagaaccaaaattattgtctgtaaacaggtgaccttaaaatatagagaaggaagcaaagttactaaacctaaatagttgcgggcctgcgctcaaagccaggcctttgttaatacttttaacaaagtattctttgttaaaagagagattagcagatacaagtgttaacatcaaacccagacttctgagtctgaaaaagagctggccggggaatgccctcctcataccccaagcccgactgcaacgcagtgactctgggaagcaacccagccttcactctagttgttttgtccccgcatcctgtgctggggtatggattctctggcctcctctaagggcagaagcttgaggctttgcctgcacgcttgggtaactgtaaacatcatcttcaggcataaaccatgggcctgtgattgctggagtgattggggcccgaaaacctcagtatgacatctggggaaacactgtcaatgtggccagccgaatggaaagcactggagaacttgggaaaatccaggtgttcttcccgcctctgaagacaacaggtctctcttccttttcaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461302 - DNA, 1704 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtt

SEQ ID NO: 461303 - DNA, 2153 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcaggtggatgtggggggttcccctttgtacactcagggctcctcacctttgggttctcaaatgcggactttgggggcccagagagcttgtgtggccagctccaggaggatgtgatgccttgagccaccacatcctgacatcccattcattcttcacggcccttctgagactcagtttcccctctcagggatgaacccttgctcctctgctggggctcagaggctcagtgctgcagaaagcagcctgcgggacacttgtccacctctctcccagaccccgcatcctgggctagggcctctccctcacctctctgccccggaccctgggtttttggaatgtgttcctgtgaccacctccctcagggtcacctggggaggctgaaaatgttggtcccggcccctccccctggctgctgccgctctgggggtgtctgcaccctcatctcctagcccctctgcc

SEQ ID NO: 461304 - DNA, 2471 bp, Homo sapiens
ctgggcctggggagcagaggtgagaaccctgcatggtctggtagcaaggagccgggctgttctcatgtgttcttggtggagctggtttgggtccacatcagcgagcctgagctccatccctaaatgcagaatcaagtgggcctgccttgctgccgccgccgccgctgctgccgctgccggagcaggaagtggtgggtcccagatgtgactcactctcattaggtagcgtggaaggagccttcggatgggtgagcctgggcgcgtctgaggaagggcaggcgggggccgggccacctccctgcagaccctggccggctgctggggccggggaggagagccaggggagcctggttgattgcttagtcagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccgggaccccacggtggaggaggcagttccactgccctggccaggtggggcccgccttggcctgtctgctgcccgaccctggcctgcttcagggagtccggcacgtctggccacttctctgtgaatcatccatgaggcttgctcaagaatgtcggcccagccagcgagtggctcctttcactctggtcctcgctatgccttggggctggcccgactgccagaccctgggggaccaagggctggcctgtgagcctccctacacatctgctggcctcactctgcccccagcacccccagtg

SEQ ID NO: 461305 - DNA, 363 bp, Homo sapiens
atgtgtagcaagttttctagataggaaacggaggcccagtgagaatgaagacctcccgttaccctccactactgcagaggttctcaccccatgtgtacatggaaacacccatggtgcttctgtgagcaaaaaccaacctgagcctgaccctccctggccacccaattcttaatcacccggtaacagccaccagatgaaactcatgcagcccgcccccctccccactccccgaaagctgggctgggcagttcagcagtgccatctgctcctgaggccttgccactcttcctgtcccctcaagaggtgaagtggtgtaaggtccggtttcttcccatccaggactggtaccatcagtcctatgac

SEQ ID NO: 461306 - DNA, 517 bp, Homo sapiens
ttgagctagaggatcccctaggtggaacagcgaggtgtccctgcaacggatggaggcagcggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccgggtcccctggtggctccaggaccccacggtggaggaggcagttccactgccctggccaggtggggcccgccttggcctgtctgctgcccgaccctggcctgcttcagggagtccggcacgtctggccacttctctgtgaatcatccatgaggcttgctcaagaatgtcggcccagccagcgagtggctcctttcactctggtcctcgctatgccttggggctggcccgactgccagaccctgggggaccaagggctggcctgtgagcctccctacacatctgctggcctcactctgcccccagcacccccagtg

SEQ ID NO: 461307 - DNA, 4357 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcagcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461308 - DNA, 4275 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggtactcaagcccaagaggtgaaattcagctgactgtcctcacttaaaggtgacctgtcaccttacttaaagggtgtgcccttatctcgtcctgggggaggggcacaggtacttgtagggctcagccaggattttagtggtggggatcctcaacaagagtggcgcgccagggcccactaggtctgggggctctggagatgcaaggatctgacccacagcctgtcccgcaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgacca

SEQ ID NO: 461309 - DNA, 2591 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggtactcaagcccaagaggtgaaattcagctgactgtcctcacttaaaggtgacctgtcaccttacttaaagggtgtgcccttatctcgtcctgggggaggggcacaggtacttgtagggctcagccaggattttagtggtggggatcctcaacaagagtggcgcgccagggcccactaggtctgggggctctggagatgcaaggatctgacccacagcctgtcccgcaggagctggagcggcagcatgcccacattggtgtcatggtggagttcagcatcgccctgatgagtaagctggacggcatcaacaggcactccttcaactccttccgcctccgcgtcggtgagcccgggtgatggagcggggtggggagcccctgcctctaggccagtccacccagtctgtgtggcacagctg

SEQ ID NO: 461310 - DNA, 2165 bp, Homo sapiens
gcccgctgccactggggcggccactcgggcggcggtggagcgggagcgcgcagcagctgctggccaacgcagtcatcttcctgtgtgggaacctgacaggcgccttccacaagcaccaaatgcaggatgcgtcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctggtgggtcccgtggtggggaggcaggcctccggggtagagggagacctccagatttgggacgcctacaatgtggccttaaaagctgcctctggttgtcctctcccccgagctcagcagcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtgtgaaaggttataacctgagtctcagttccatcatctgcaaaatggggacaaatataacagctcaccttgctgttgtgaggacaacatgggatcatggggggacagggtgctggacacagaaagagtaaccagcacatgggtgccaacgatggccataaccatccccactcccg

SEQ ID NO: 461311 - DNA, 1706 bp, Homo sapiens
gtctgggaggtgtacccaacagctcattgagaacgggccgggatgacaatggcggttttgtggaatagaaagggggaaaagatgagattgaaattgagccagtacgacagagcagcgataaaatgctctactgtgaggccgaatccccgccgactgttgaaaaagtgaaaccagcccgggagaattcggaaacagacctggagattgaaggcgagcatgggcatttgggggcagtcagggcagcttctcctcagaaactggagaaatctggtttccaggagctgtcatctcactcctttccagagtctgccctgcggatggcctgtggaggaaatgtggcagaaaggcctgctcgattttgcctggagtcctcctccgggctggcaggggagagcagctgcagcttcccacgcttgtcacctgcctcaggagcagtgccctcacgtcgtcttgttaaaagcggaatcaatacacaaacaagtttccccaagaagggaagcaccgaaagagaacacttgtgaagcaagagaatgacgctggttccatctgacagggtcagcctcaaacttcccaggccaagcctagcccagtcacccttcctcccctgcatccttgcagctggctggtgggcagtgattcacaggcagcagagatggaggaaggccagttctgccaaattaaactgtgaagttcatctgcatagagtcagtttataaacctccccaccatggtcaacatacaacatacatcttcacccttctacgcagacctcctccccgctgacccccaggcagcttgttgctctttttctggcttcttgtccacttcaagtctgttgttaacgttgcttctaacacccaacttcattcacatggttggagaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatggtactgtgcccccctgtgctggctcttaccatcatccctggggattcacaacccactggagacaagccagaggccctgccaggacccaggctgcctccaggctcctgcccgcccctgcccttcccacacgacttcttagaggagggccacatcacaggactcaagtaaaccacaaaagacatcattttttcatgagggccctttggtgagcttttttacataccgaagtgttttcttgccttttagaatatttccaacaatcaccttggtttggagggggccagaatcatctcagatttctttgagagaaacagttcttctatctggagccttgagctttcagaccaattaccaaattaaaaagctggatctcagtcacaaccaattctctgatgtaggaggggagcacctgggccagatgctgggtgagtctccctggaggaagggacagcaaaggggagggatagggaagaatcacttggcagagcggaatctcccttttaaacatgatttttaaatgttgtgattataaaagtgatgt

SEQ ID NO: 461312 - DNA, 1772 bp, Homo sapiens
gtctgggaggtgtacccaacagctcattgagaacgggccgggatgacaatggcggttttgtggaatagaaagggggaaaagatgagattgaaattgagccagtacgacagagcagcgataaaatgctctactgtgaggccgaatccccgccgactgttgaaaaagtgaaaccagcccgggagaattcggaaacagacctggagattgaaggcgagcatgggcatttgggggcagtcagggcagcttctcctcagaaactggagaaatctggtttccaggagctgtcatctcactcctttccagagtctgccctgcggatggcctgtggaggaaatgtggcagaaaggcctgctcgattttgcctggagtcctcctccgggctggcaggggagagcagctgcagcttcccacgcttgtcacctgcctcaggagcagtgccctcacgtcgtcttgttaaaagcggaatcaatacacaaacaaggttttctaatcttctaaatgtttccacgtggggcatcctatgcaatctttgcaatagtcctaggagtttccccaagaagggaagcaccgaaagagaacacttgtgaagcaagagaatgacgctggttccatctgacagggtcagcctcaaacttcccaggccaagcctagcccagtcacccttcctcccctgcatccttgcagctggctggtgggcagtgattcacaggcagcagagatggaggaaggccagttctgccaaattaaactgtgaagttcatctgcatagagtcagtttataaacctccccaccatggtcaacatacaacatacatcttcacccttctacgcagacctcctccccgctgacccccaggcagcttgttgctctttttctggcttcttgtccacttcaagtctgttgttaacgttgcttctaacacccaacttcattcacatggttggagaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatggtactgtgcccccctgtgctggctcttaccatcatccctggggattcacaacccactggagacaagccagaggccctgccaggacccaggctgcctccaggctcctgcccgcccctgcccttcccacacgacttcttagaggagggccacatcacaggactcaagtaaaccacaaaagacatcattttttcatgagggccctttggtgagcttttttacataccgaagtgttttcttgccttttagaatatttccaacaatcaccttggtttggagggggccagaatcatctcagatttctttgagagaaacagttcttctatctggagccttgagctttcagaccaattaccaaattaaaaagctggatctcagtcacaaccaattctctgatgtaggaggggagcacctgggccagatgctgggtgagtctccctggaggaagggacagcaaaggggagggatagggaagaatcacttggcagagcggaatctcccttttaaacatgatttttaaatgttgtgattataaaagtgatgt

SEQ ID NO: 461313 - DNA, 2903 bp, Homo sapiens
aaaactgtacagtaaaaatggtgataactgtgtagtttcttatgatgctctcgtggacaagatggaggcacacacagtggctgcagggactggtgggaagaggggtgcctgaggagtgctgatcagatgagcattgtggaagcattgcgggatcacatccttttggcaccgggggctgctgttttgtcccctgctgtgttctgctaacattggtgtcgatgaatgacaccagactgcatggcaagcagccccaccaaagggttgacaatgagcgtcccagtggctcctaagaaatcatgttacactcagttgcgggacaacagaaatgcagcaagaaataataatgaaagcatcttaagtctgggagatacgaatgccaatcaaatcatgttggaggtcagctcctctcatgacgagtccaagacatgtgacctgggagatgaaattggaaatacaaattcaagtgagccagaaaaccgtacccatttccataaggaatttcaccaacttcagggctttgggaaaggctctcaggctggctctgccagcctgaaagattttagactttcttcaaccattcagagggaactcaatgaagagcacacagtggagagaggcacagatagcctgcagaccacgcggagtattcagggaccaagtctgtcgagttggaggaatgtgatgagtgaggccagtctagacgttttggctaaaagggatgctgaaattccccggcatgttcccaaggataaactggcaaagacccttgacaatgaggaactgaggaggcattctttggaaagagcaagcagctctgtagctgcagtcgggagcctgactccgcagcatccacagcctctatccctcgactcccgggaagcacggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggtaagagaatgtcattatgatatggtctataagttgactgtcccaatatctgtgacatattttcaatgagttatgaaagtaaaatgtcctctttaagtgaattacagattttcatggatacacttgtgaagaaatggagtttttgactagaggagattgtctagagaaatgaccatttttaactagaagagtctgattatcttaataagatgtacccaatatctaaggagacccatttaaatttcacttgctataattcatatgaaattagatgagtatgccttaaataggcttccatgtttaaataagtgaatataatataatataagccaggttaaaggaagaaagaatgcaaaattactgtgttcttcaaatagatcagactcattcctcaatggggagtattttctacctgggagtatctcttattc

SEQ ID NO: 461314 - DNA, 2000 bp, Homo sapiens
caccacagggctcatgctagttttctctttctgtattttcagttctcttttccttcaattcagacctagggaatgtggggggtcgttcatttagccagaaatggggcaagggatttgagagttttgctcatagaagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagccgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatgactctgttacggcatggtgcaaatccagatctgagagatgaagatgggaaaactccattagataaagctcgagaaaggggccatagtgaagtggtagctattcttcagtctccagagggttgatgaatccagaagctctgtgaaataatttttggaacgaagtggagtatccaaaattatcttcttaatttgttattgagcacattgaagttactagtgctctttagtattcttataagcatcattgaaacaatgttctaatttcagtgtatttgttaattagagataattattatttgaagttggatatatcttaaggtttttttccttgaaagcaaaagtttccaaaaaagtatttctttaaaaaatatttgtctgtaggtgattggatgtgtccagttaataaaggagatgataagaaaaagaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttaaaagaagtttgtgattctgatgttggtcacaatttgcctacaatactagtggaaatcactgcaactgtcctggatcaagagactgcaaatttaaatataccttttctgtgtctagtggttcccagcaagatttatttctaatatttagtgaatgcttactgtgtgttaataacagggtagtaatatttttgaaaaaaatggtggtatatgagttaataattgtagaatccc

SEQ ID NO: 461315 - DNA, 2371 bp, Homo sapiens
aggtgagtcagctaggccccttcctcctccagtgcctgtctacctatgtttgatgcttggggctagaaagactgaccttgtagcccctcaccttctctccccaatgcactgggctggttcagcagctgaccaatgagggtcatgcttgcatactggccttgggtgagtggctcaggaacagtttgcaagaccgtgttgaagctacttgtaactagaccattttcccagcttgaccatgagcttcttcaaggcatctcttctcagtctccactgtagctctgtggggatgctaaccctggcttccaaggatctgaagaggaagctgcggctgtgactgtcccttttcggtctgtcttcatcctgcctgactcacgggtctcctgtcctcctgcatagcttgcggtggtgaggtgatggcagccatggacacaggccagagagctgacccaagcaatcctggtgacaaggaaggggaccttcaagggctgtggcaggaactctaccagctccaggctaagcagaagaagctcaagagagaagtcgagaagcacaagctttttgaagactatctgattaaggtccttgagaaaatccccgagggtatgtacacagcttcctcggaaagccctttctctccacagccacctactggctgcaggactgcgacaccgtgtgtggcctcatggagccacgagctgctcatctacagaatgggaatccacaaaggccaaccccacagtagtggggaagggctcaggcagccgagtctgactgcttggtcccaactccagctccactgtcgctaacagtgtggcctctggcaagttctcaaggccttgattttcttatctgtacaatgggaacagcaataattatgtggactagatgaagtcatcctttataagcacagcacagggccccacatttagctagtacctggtaaacgttggccattattattattattttgtttgtctttggttttgtgtttttgtgttgctattattaactaagagtataaggacatctgagatgaggttttctgtgttgttttatgagtactggaaactcattggaaaagggaaggggagtcacacatatttattgttatcattattatttcaacaccatcaataataattattaccatttattaaatatgtaccctgtgctaagctctttagcaaatcttttttacccctcctatgagctttgcactactgtgtcactcaggctcagagagggctgctccaagcagcaacatctccttgagggcagtctcccgcctcgctcggggcacccacccatcccgccatggcgctgtctccgtaggctgcacgggatgggaggagccggaggaggtgctggtggaggccacggtgaagcactacgggaagctcttcacagccagccaggacacgcagaagcgcctcgaggccttctgccagatgatccaggctgtccaccggagcctggagtctctggaggaggaccacagggctctcatgttgagcctcaagatccggctgtgtcagctgcagaagaagtgctaccgcaagcaggagcagtggtggcagctgaagcacagcatcacttaccagaaggacattgactttgacacacacaccagcagcagctataatgatcagctgctcggctacatgcaaatgaccatcaccaacatggcccggcagtgctgcccctctgcccacggcgtgcccaagagcatggatctcttctccaagctcgatctgattaaggactcagtcatgcatgggatgctgcattcacagatccaagagagggagcctcatccccacctgctctccagcaccatgaacagtgcacatgctgagggcaggagccctgtgtcctttatctccaactccctgtgcctaccggggggctggcacaaagcaggtggtgctcggtgttgaaggaacaggtgcgtgtgtgcatgaacaagggagttaggttcctcacggggtaccagaatgctgcttactggctaccgtgcatccctgagttgtccccgcaacctgtgagccagaaagtttttcctaatccccttttataggaggaaactgcagctcagtgtgaaaatgtgccttgtctgaggctacacagacagtcagtggttgagcctggacatgaattcaagtgcattgggctccaaattgaaccactgtcactgtcacaggacagttcagtagtaaaggaactgtaagaacaagagctcacgtgtgggatgcttgctggatgctaagctcattacagcttaggcagctttccctgcaggagtgtttatcccattgtacagatgaggctcagacagtttaaaagctttcccaaggtcacatagccatcatgt

SEQ ID NO: 461316 - DNA, 251 bp, Homo sapiens
tatgacttcttccatcatttatttgaagccagcacttgttgaaagttcccaggcatcttggtggccaggaactgaagacttgggggtgatggggctgtaccagttatagggccgcaagtgaaacaaggcccctgcagaatggcaccctcaacctctccagagctggggatgcagcccgaagaccttggacttgggatttaatgagccctgggtcctcatccagtcctgccagatgaccttaagctgctcac

SEQ ID NO: 461317 - DNA, 824 bp, Homo sapiens
aggtgagtcagctaggccccttcctcctccagtgcctgtctacctatgtttgatgcttggggctagaaagactgaccttgtagcccctcaccttctctccccaatgcactgggctggttcagcagctgaccaatgagggtcatgcttgcatactggccttgggtgagtggctcaggaacagtttgcaagaccgtgttgaagctacttgtaactagaccattttcccagcttgaccatgagcttcttcaaggcatctcttctcagtctccactgtagctctgtggggatgctaaccctggcttccaaggatctgaagaggaagctgcggctgtgactgtcccttttcggtctgtcttcatcctgcctgactcacgggtctcctgtcctcctgcatagcttgcggtggtgaggtgatggcagccatggacacaggccagagagctgacccaagcaatcctggtgacaaggaaggggaccttcaagggctgtggcaggaactctaccagctccaggctaagcagaagaagctcaagagagaagtcgagaagcacaagctttttgaagactatctgattaaggtccttgagaaaatccccgagggctgcacgggatgggaggagccggaggaggtgctggtggaggccacggtgaagcactacgggaagctcttcacagccagccaggacacgcagaagcgcctcgaggccttctgccagatgatccaggctgtccaccggagcctggagtctctggaggaggaccacagggctctcatgttggtaacagctgcttgaagtctgctccattccccgtggcccagggag

SEQ ID NO: 461318 - DNA, 415 bp, Homo sapiens
gtcctcatccagtcctgccagatgaccttaagctgctcacagcccctttctgaacctctgtctccttttctgtgaggtggggatgctaaccctggcttccaaggatctgaagaggaagctgcggctgtgactgtcccttttcggtctgtcttcatcctgcctgactcacgggtctcctgtcctcctgcatagcttgcggtggtgaggtgatggcagccatggacacaggccagagagctgacccaagcaatcctggtgacaaggaaggggaccttcaagggctgtggcaggaactctaccagctccaggctaagtatgtgttgtcccacccctgccccagccccagccccagtgcttccccagtgggctaagtggctggacttagcaaacatgtccccgaggaggccaggacagg

SEQ ID NO: 461319 - DNA, 792 bp, Homo sapiens
aacctctgtctccttttctgtgaggtggggatgctaaccctggcttccaaggatctgaagaggaagctgcggctgtgactgtcccttttcggtctgtcttcatcctgcctgactcacgggtctcctgtcctcctgcatagcttgcggtggtgaggtgatggcagccatggacacaggccagagagctgacccaagcaatcctggtgacaaggaaggggaccttcaagggctgtggcaggaactctaccagctccaggctaaataccttctttgctgcctgggagatgctgctatgggcgtttatttgatctgcttgtggctcagtttgctcagcagtgaaatgaaggtgcagagactcctaagtctatggccaactgataaagtggcagaagaagctcaagagagaagtcgagaagcacaagctttttgaagactatctgattaaggtccttgagaaaatccccgagggctgctccaagcagcaacatctccttgagggcagtctcccgcctcgctcggtggtcttgatccagaatccctgtctcagtctctggctgaactttccaaggctgcacgggatgggaggagccggaggaggtgctggtggaggccacggtgaagcactacgggaagctcttcacagccagccaggacacgcagaagcgcctcgaggccttctgccagatgatccaggctgtccaccggagcctggagtctctggaggaggaccacagggctctcatgttggtaacagctgcttgaagtctgctccattccccgtggcccagggag

SEQ ID NO: 461320 - DNA, 585 bp, Homo sapiens
tcactgatcctgtgaagtaagaaaatgtacagctctttcagacacttggaaaaatcaacagagccacaagagccagataaagaagatgacagctctgcccaacagcagagacataggaacattagccaggaaaatgcatcacagaagaaaacagttactcaggttgtcactcatactttgcagataaggaaactgaggctcaaagtcatattaacaagtggtgcagcaaaagcagacaccttggtcctctggtttccagtctcaggtggccctcacccaggatgtgattccagcagcatggattattgcaaaaatcaagatgcagacaaaatggcaaatctgagaagagatggacaggcaaaatggagcacaacggagtcactactgctacgtcagtgtggagtcgcaccttgagccatagtgttacttaaccatgttccttgatggcacacagaatgttatactgtaatatagatgtaaatattaatataatatagaagcatatagtatatatatcatactgtaatatagaaataaatattatacttctggaattctggaaatagttctgtctgtgatgtcatc

SEQ ID NO: 461321 - DNA, 5587 bp, Homo sapiens
gcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggatccccgctcctttactgggccctcatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggtgtctccaaggacctgggtcccagctctgtttttccctcccctatcatggagcgatgactcggacatcatgctgatgtggtccctccccctcaccaggaagagtggaatgtagtgattcagcaacaggtatccacggggagagccctacatcatctgctaccctgaaggatctggaggtaagaggctctgggcagaggtgcagtgaccctgcagggcagccctccaacctcctcctccagagcccgtgccaagaactagcagtagtcccagactcgaggaaaagaaagcaaacaacgagaaacagaaagctgaaagggggctagagcacttgcttggcttttctcccaaaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagagggtgagtccaaccacctgccgcgtcccctggtagcctggcttcacagacagaggagtgagcctaaaggtcccttctgcaggatggagtgtcctgcccagaaggcagcatggccatttctcactgcttttttgtatggttgttagcggcagcttgggactgagtcagctgctgtggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagacgctggagaggagcttgtccaaactcaaacaccagatgggtaagatggggctggcgtgacctggcagcaggactggcatcagagggctgtgagggtggcttggagtgccccagcgaggtgggtggatgggaagggctttgaggcagagggaaagaggtctgtgccaggagacggcaagtcttgtcatctcaatgagcctcagtgtccccatcagcaaagagggcccgttgtcagccacccgcagtgctctttctctgaaagtggtttggaagactggctaccatctggctgaacccttgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagagacttcgggagcaggaggagaggcttcaggagcagcaggagaggcttcgggagcaggaggagaggcttcagcagctggccgagccacagaacagcttcaaggagctgaacaatgagaacaagagcgtactacagttggagcagcaagtaaaggagctgcaggagaagctaggcaaggtgaaggagacggtaacctccaccccatccaagaaggtctgggaggtggagctgaagagccaagaggctcagagtctgcagcagcagccagaccattacctgggtcacctgcagcagtacgtggccacctatcagcagcaggagcgcctggaagctgccagccagcagaaacagcagctaacggcccagttgagcctcatggctctccctggggaaggacacggaggagaacatctggacagtgagggggaggaggcacctcggcccatgccgagtgtcccagaggacctggagagcagggaggccatggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctagcggctttatggaccacctggaggagaaggcagacctgagtgagctggtggagaaagaagaacttggattcttccagtactacagagagagatgccatcagaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctgcgtggagcctgtgcaaggagaggccagggagggttctccccacgacaagcctactgcacagccgatcgtgcaggaccaccaggagcacccaggcttgggcagcaactgctgtgtgccattcttttgctgggcttggccgccaagaagaaggagataaacatgaccatctgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtagttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctatggattaaatcacatactggcatatttaagctgaatgtcaatctggaaaataaattgactgtattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttagaatgaattttaccaatttatgaattcttgtaagc

SEQ ID NO: 461322 - DNA, 1074 bp, Homo sapiens
gggctctggaagcttggcgctcactcagctcccagaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaaggtatatttgtaagccgagttgaatgctttgtggagagagatcccattcaggagggctaagcttgaatccaggacttactgaggagcaatcacacagaaaaggacagacacttcgagggaagtacctcagaatgagagccttgcattcatttactttggctcagtagctcctactcctatagcatttgggaaggaagaatgattgcctccatcccatgtaacacagctcatattatacagaaggagaatgcaaacttccttctctcaagcctctaaaggtggaagcaaacctaccttacaaacagcaggcttgctcctaatcagtgccgtgaagggaccaatgctgcctggtacatggagtcagtaggaggatgggcagatggccactagcatcagtgacaatgcagcctggagtggattcaacagacaacacagacttcccttcactctcatctctgcccccaccagaggcactgagtcactggcttaactgagtcactgaacctggaagggaccacgtcctccttcattcactcattatctcagtcagcatatacctctatgtgtcaggcactgtcatggccgctgctccagcaatagataggacagggcccctgccctcaaggagcttccagtccagtcagggctaccccttcaatgccacccccctgctggagagcctggatcttgggtaaggttccacatctgttactgctgtaacctggtgatgtcacttactcctctgtgtcttggtttctttatctgatatgaaagtctcatgacttgctgaataaatgtcataacatttcatttaactca

SEQ ID NO: 461323 - DNA, 901 bp, Homo sapiens
gggctctggaagcttggcgctcactcagctcccagaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagacaggtttctaagacagccaccgatgggtcctacctcctcgtattcacatcctatgtaatctcctccccagtgtgggctggacctggtgacttgcttccagtgaatagaatatagcaaaagtgattgatgtcacctccaagattcagctatagaagactatgactatgactttcctcttggctagcattctcgctaacccttcctgcttgcttgtactgagctgccctatgaagaggcccatgtagggtggcctgggtgggggtgatctgtggccaacagccagcaaggaactaaatcctgtttacaaccacatgagcttggaaggagatccttccccagtaaagccaggagatgaatacagccccagcctccagcttcattgcagcatcgtgagacacccacaagcaggactcagctaagccacagccagaattctgtcccacagaacttcaagacaactagtgctgttgcttttcagctgcagagttttgacataatttgttgtatagcaatagccagctagttatcaataaccactattgctcctattgtttctcaccacatatccatatagtcatgaggaaacctctttaaatgagacaaagaatcagaactaataaaagataagcaaattcctttaaata

SEQ ID NO: 461324 - DNA, 2015 bp, Homo sapiens
gggctctggaagcttggcgctcactcagctcccagaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagaaaaagcacaagaaagatggacacatggcagagtcttaaagtcaaagaagtattctgtaagcataattcttcctatgaatgccttctctataaagaggttgaagcaaggtatagaggccagaagaggtcattgtctccaaatagcaagcaagacctctccgaggctaactttgtgcagtctgtaggtgtattcatgccgtggctcaaatctttaaatccaactttaaagatatttttatccttattcaaaaaacatatccaaaattaaaaatatatatgtgctttttttttaacttagaaaactcttatatccctacttaaacatgtgcaaagtacaaaactttaaaaagacaaagttataatcagaactgcccctcaaatgtaaattgcacctctccttgaagacatgcagcagctctgggagcctcgagatcactgctgcccggtcatagtgtccccaacgatgggtgagcgccctgggaggtttcctcagaggaccgtgcaggcagtctggaggcagtggtccacattgcggtgtggcctctgtggctttgccttctactccagacataaaatccgagggcttcttgcatgggctgatccggggcaccgcctaccttgccggctgggcagctacaacctgaaacacctggaatctgagtccccagccttgccccccgcagctgccagcttcttctgtcctgttggtccccgcgggaactggttggggaggggacggggcggtggtactggagggctgggccagtcgccagcggtgctagagaatgagttccggtcctgccccgcaccgggctggcactgggcacagggacaggccttggaccccgcgaggaccccactgctgaaaccgccccagccgccgccctccctgagtgttcactcagctggactaaagacctgaatctgaaaagcaaaatttgaaacaataaaggagaaaacataaaaatataatttaaaaagtaaaaagtaaattggaaaaaaatcaaaatatatctttcctacattctgaactcaaggaggtttgtagacacaaaactgctctgatatcctatattcattacttcccagtgagtaagtctgaaataattgacttggtaccgggagtggttaccaacctctgattgattggttaattagtgtggatagggctaacagtaacaacccacaaaatatctaaagatgggatatagcaggctaaagtcagcaagacaaccttcttaattattaccagaagagtcctttaaccattcaacaaaatggagcaacagttaaaaatctgctacaacaaaaagaaaaggccaataccattctctgacagttttcaccaaacatgcatagaataaattattttaatcttatacaaagttcatcaaagaatagaaattagagaaaatggtccccaatttgtactataaggctaaccatgtttggcaaggttagtattatctactggtgcattagttaatagataagtagataaattagttatctactggtacataacaaattagcccaaaacttaggagatatgggatcaattgcaaagtattcaacattttaaaataaaatttggaactaaacatgtggttatgtttatctctcaacataatcttcatgaattaataagccagaaaatttgcataccaattgttaagcattaagagatttttttgaaaagtttagtgattatataatggcatacttagaaaactaaaatgaaaatttgaataatgtggct

SEQ ID NO: 461325 - DNA, 661 bp, Homo sapiens
gggctctggaagcttggcgctcactcagctcccagaagttctcagagggtgagggtcccacatctcctgcaggacaggccctagctaccgagtcacagaaacccagggccgaagcaaagtcccaatcccagagaggctggggcacacctacaactgaaaggaggcttagaaatccttcagagaccaccctatcggttctcctccacctggacaggatgagccagcaacacagaaggaagaggccttcctccgaaagacaggtttctaagacagccaccgatgggtcctacctcctcgtattcacatcctatgtaatctcctccccagtgtgggctggacctggtgacttgcttccagtgaatagaatatagcaaaagtgattgatgtcacctccaagattcacatcgtgagacacccacaagcaggactcagctaagccacagccagaattctgtcccacagaacttcaagacaactagtgctgttgcttttcagctgcagagttttgacataatttgttgtatagcaatagccagctagttatcaataaccactattgctcctattgtttctcaccacatatccatatagtcatgaggaaacctctttaaatgagacaaagaatcagaactaataaaagataagcaaattcctttaaata

SEQ ID NO: 461326 - DNA, 2599 bp, Homo sapiens
cgccctggttctcagggccgtgaccaccaccatgaccggcagacttcagggcggaggggcggccgtcggtcccgagtcccccaccccatcctggacacccccacgcgcgcacacccatggcggggcaccggctgaccgggtgggcatttggagggccccatgggagcgggtcccgggccgcgccggtgtgctccttaacccgcggcgacacatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcgtgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggatcgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctctgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcctccctcgccaccttccccaggccgcggaccccccgacgcagagtctgtgcacagcatctaccatgccgactgccacatagaggggccgcaggagagggcccgggtggcacatgccgcagccactgccgctgccagcctcaggctggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcaggcactacggggtgcgcacctgttaggtcagctgcgtctcagatgtttctagaaactagcggagctgttccctgcaggaacaaag

SEQ ID NO: 461327 - DNA, 2426 bp, Homo sapiens
cggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcgtgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggatcgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctctgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcctccctcgccaccttccccaggccgcggaccccccgacgcagagtctgtgcacagcatctaccatgccgactgccacatagaggggccgcaggagagggcccgggtggcacatgccgcagccactgccgctgccagcctcaggctggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcaggcactacggggtgcgcacctgttaggtcagctgcgtctcagatgtttctagaaactagcggagctgttccctgcaggaacaaag

SEQ ID NO: 461328 - DNA, 566 bp, Homo sapiens
cggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagtaagtgaccggccccgactgggcttgagatcaacaggcttgcgtgtccgccagccctgcagagctctcaaaagggcccccaggagcacaggactgggaaatgaaggttaccaggcactccggccccagcccagaccccagcagtggggtggcccctgccgctatccgcgggccttgtacatgt

SEQ ID NO: 461329 - DNA, 1750 bp, Homo sapiens
ccacctcaggcagacccgataccgcgtacccctaagcatgagtctcactctgtcgctcatgctggagtacagtggaaacacccaggtctccctggcaatcttccccttaagcttcagacagacggctgctgatggggccatctggatggagacttgggactcgggcttgtgttttccaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggtaagcacgcagggcctggaggccatggagggagcaaccctggggtggaagctggggggtgggggtggcgcacctgtctttcaatggtgatgtattatataactgtaggacaagacccaaaccaggaaaccagcattgttacaatactgttagctagactgcagactttgttcagttttcaccgtttttaacatacattggtttatggatatgtttgtgtagagttccatgcaattttacagatccaggtaactaccacccccgtcaaaatacagaaccaatccatcatcacaaggatctccctcatgctgtcccttgtatttgcacccttatcccattcctgtcccctggaaaccactaatctgttctccatctctacagtgtcatccttttgaggacaaatgaaattatgcagtatgtaatattttgagattgactttttaattcactgagccttgagatccatacaagtggttgcacttaccacaaccaatagctgattccttcctattgctcagcaggatttcattgcatgggtgtaaaataatttgtttaaccattcacccactgaacccaaacaagacatgtctgtgcaagtaatggctgctggactgtgacctctgagtaaaggataggtgtttcagggcctcatttttattcttgggaccatatggtgcccccagcaggcttgggaagtgaccttctaaagtgcacagatgggcctgcagggatgctgtgtgggccagctccaggctgccattcagaggcagaatcaactctgctctctggccttgtgactggggaccaggtggcttcaccccttcacgtcccgctattcttatatgtgacatgaaggcgctacattatgattcttccacaaggcagtttaaaaacatggctgcaaatttcttgatactccttccatgaagagttgtggcttaggtcccctccccttgggtctggctgggttgtgactgtttcaacttgtggactagaacagtgtttctcaacattttttcattgttatcctaagataacaatgaatatccctaaaaaaagaatatccctaaatatctcccctcatgaaatgttaataccaaagatgtattgtaca

SEQ ID NO: 461330 - DNA, 1615 bp, Homo sapiens
gaacatgtggctgctcccagctctactccttctctgcctctcaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggtaagcacgcagggcctggaggccatggagggagcaaccctggggtggaagctggggggtgggggtggcgcacctgtctttcaatggtgatgtattatataactgtaggacaagacccaaaccaggaaaccagcattgttacaatactgttagctagactgcagactttgttcagttttcaccgtttttaacatacattggtttatggatatgtttgtgtagagttccatgcaattttacagatccaggtaactaccacccccgtcaaaatacagaaccaatccatcatcacaaggatctccctcatgctgtcccttgtatttgcacccttatcccattcctgtcccctggaaaccactaatctgttctccatctctacagtgtcatccttttgaggacaaatgaaattatgcagtatgtaatattttgagattgactttttaattcactgagccttgagatccatacaagtggttgcacttaccacaaccaatagctgattccttcctattgctcagcaggatttcattgcatgggtgtaaaataatttgtttaaccattcacccactgaacccaaacaagacatgtctgtgcaagtaatggctgctggactgtgacctctgagtaaaggataggtgtttcagggcctcatttttattcttgggaccatatggtgcccccagcaggcttgggaagtgaccttctaaagtgcacagatgggcctgcagggatgctgtgtgggccagctccaggctgccattcagaggcagaatcaactctgctctctggccttgtgactggggaccaggtggcttcaccccttcacgtcccgctattcttatatgtgacatgaaggcgctacattatgattcttccacaaggcagtttaaaaacatggctgcaaatttcttgatactccttccatgaagagttgtggcttaggtcccctccccttgggtctggctgggttgtgactgtttcaacttgtggactagaacagtgtttctcaacattttttcattgttatcctaagataacaatgaatatccctaaaaaaagaatatccctaaatatctcccctcatgaaatgttaataccaaagatgtattgtaca

SEQ ID NO: 461331 - DNA, 3061 bp, Homo sapiens
gactcctacattattattacaggaaatcttcgctgctttggagactaaaagagcccaaaggcaggtaggtgagccgcggatacaagcctccctgtctccctgttgttgcatacaggtctcacaggaaactaagtgaggagtagggagggcagtgggttaggaacagcgatggccagcagatggcgccaggccccaaggcatgacccgctggccgcaggcgcgcctaggagtggccgcgaagctagtccccaaacaaagctggagccaatgcgctctctgggagtccagagctccccggggtccgccctgacccgtggctccgcctcgcctcgctcccgcgcccagagcggcgctcacagggccccggtggctgacgattgtgtcctgcgtgggataatcgaaagtgtgcacaagtcactcactgatcagacgtcccagggagaccgaggggtggagctgccgcaggacctgcctcattcagatggaaagcaaatggcactggaagaacgtttcatctcctgcatctgtgggatcagccccagtacaggcaaaaatctcatgctttcataccagcccctctggggctttcatctctgctccaaaaaaatggacagcttcaaaaattcaaaaatcaattggaatggagccagctctgtccagcgggttattaatggccctggagctgactaatcctatttgcacagccttttggtaaacagcttcaacaacaactagggtggaaaagaaaacacacaccccatccaatcaagacaaacttcaagtattgatttcactgcctccttctcccctgctgccacttttgaaacaaatttagaatgtttttgtctcctatttgactatgttgtcaccctagtggttgagactgaggacactgtctagggtccactatccaaataatgacaatggggaagggatgcctcacatgagcagattcccatagtgtttgtcatgaacggaattgcatagagtttgttatgagcagatttgcatagttttttgtcatgagcagaatcacatagtgtttgtcatgagcataattgcatagtgtttgtcatgagcagattcacataatgtttattgtgagctgatttgcatagcatttgtcacgagccgatttgcacagtatttgtcatgagcagaatcgcatcgcatttgtcatgagcagaatcacatcatatttgtcatgagtggatttgcatagtgtttgctgtgagcggaatcacatagtgtttgccgtgagcggaatcgcatagtgtttgtcatgaatggattcgcatagtatttgtcatgagcagatttgcatagtatttgccacgagtggaatcacatcatatttttcatgaatggattcgcatagtgtttgctgtgagtgaaatcgcatagtatttgccgtgagcagcatcgcatagtgtttgccgtgagcgaaatcgcatagtgtttgccgcgagcggcatcacatagtgtttgttgtgaatagattcacatagtatttgtcatgagtggaatcacatcgtatttgtcatgagtggaatcgcatagtgtttgctgtgagtgaaatcgcatagtgtttgctgtgagtgaaatcgcatagtgtttgtcgtgaatggattcacatagtatttgtcatgagtagaatcacacagtatttgtcatgagcgggtttgcatagtatttgccatgagtggaattgcatagtatttgccatgagcagaatcgtatagtatttgtcatgctgtgacggaagaagtttagcagaggattatggagatggtctcagcaacaagactgcctggatttccatcctagttcctgccccaggtggcttaacctctctgcagttccgtttcttcacctgtaaaatagggataagaattctgttggaagaattaaataagctaagaagtatggagtacttggaacaaggtaccaggtggatacttgagtgctaagctggttgtccttgggcccttcatgccaggctcccagaggccctgcactctgaacatcaggcaatgcctctctatgatacatagctttaatcagcagcaaaataaaatggggctcattgaataaggcttacaaagatgatgagctcctgcctgggtttgcactgcctgctgtgcggacgagccgcatctgtggactcctccttagtcagaccaagctgccatctttaccttggctccaaaggtgacctatgagctgccacacctactctaggaatgcccagcaaagtcctgacttggcaacagggaccagggatagagactttgacacatctccggtgactcttctggaaaggagtggaagatctgccggtgagcaatagaagcgtcacaccccggttcccaaacccagccctagacattctggtgccaagaggtgtcacttcctggcaaaggtgaagggagggtcagtttctccctgctgttcctgattccatcagctcttgacccacagagcaaacatgtgcccagcctctgcagcgacaaccaggtgttctcctggactcaccctggcccagatccgctcggtggagttggcatctgctgtgagcctcccatttgatttgacggtttccatttagtaggtatttgtagatgcagccagtcctttgaagaattattatgctcataaagtgcagagaaaatggtatagccctgcctacttctcagttttctgaggctcaggaatcagcacgttgttttcctgatttcgctctaggctttcttcactcccgtaatgagcagtaggggtcactgtgtagccacagaacgcctccacgaggctccagaaatctaactccacctacctctgggctggaccagaacacttggatgaaacggccacgtcaccacatcttcacaaagtcaggggacacatttagcaggatcttttctgattgaaatgatcaatggctatttctatgttgctgaagtgaaaatgaatatagtggtttgggttggaatcactatgttgatataatacatatatagtgatataaatgactatattgatataaatgatattgccaccaact

SEQ ID NO: 461332 - DNA, 1651 bp, Homo sapiens
gtgaccttgacaaggacccagagataaagatccttcccacatggctccgaagcccctcccttcctgctcacaccgcatgcctctcccagagaactagaggctgcagcggcagcagttggagcatctcactgcggggctcgggaaggaggaaaggagtgagcatgtcctgctcctgcatgtccctgcttaagctcaggactggcccttccaggccaaggaccccagcatagaccccaggacagggccccaaggatccctggctcatgagagcggcttgctgggctgccccaagagagcctgaaggaaacacattgttgagctgagctgacgtcgctgtttcttccagactgctctctaaagtgggcagggtagcgaccggccggctccgatggtgacgtcccactgccaaggggtgggagtggggagagtctccacagagcttcggagaagctgctaagatggaaaagtggaaacttggcagacagatccagcctccctggccactggcccatgctcgtggctcctggatggcgctgccacgttctgagcagcttgggacaggtggagatcaggactggcagctgcaaggacacaccagagccacagaaactaaagagaatttccaaaaggagtctatggtgaagtctctgaggatgcaaagaagacaaggagaatgaaaatccaatgaaagcctgattgtatttgttgaccttaaggaaagtgattttatggtacagcctctctggaagggagggtgtgttcgctcacagaatgcaaataccctttgaccccctaatctttcttctaggagtttctcctacagataaacttagaagggtgctcaaataagtaagttcaaggatatcctctgaagcattgccgtagtataaaaaaagcacagataccctcaaaggacatcattaggggcctggtaaaataaattccacacagtggaacaccgtgtagctctttagagaataaacagctctctatatgtgatctggaacaatctccaagctatattgtgaagtgaaaattacaaacccttactgaaaagcactaaagaaaatccaaagaaatggaaaagcaaagcgtggtcttagatagaagactcaatatcattaaaaaaaaaaaaaaactcataatcaggcaaggagaagacactgattaccatcagattggcaaaattaagccatctgatgatgtctgtggagctgttactggaaagggtcccaaaccagaccccaagagagggttctttgatcttgagcaagaaagaatttgggataagtccacagggaatgtggcccagcaggtctcagcatcattttacccagcccctattcaagttaaagttgctctgcttccaatgcctctgacatatttcccccctcctttttacaagaggaccactaatcctaagggttgtagagaaagcatcagcatactgacggccattcataactctgagttccaacaaaaggtgatatctggaagactggcaaatgttcaatttaagaaaacggcgagtaagcttattctgcattcctacacaacgagtacaacaggaatatattccacaatagtaaagcaaaataagtaaaattatctgatatggtttgcatctgtgtccccaccaaatctcatgtcc

SEQ ID NO: 461333 - DNA, 1584 bp, Homo sapiens
ccttgagagggccagggcactgggccaggaaggaggcagaagcctgcaggagaggcctgtggaggggcttcgggcctcagacaagcccctctctggtgtccttggagcccaggatacctggctgatgccatcacctcagcggttggcctgtgaggccggagcgctggcacacagtggctacggtggcaccatgtttggtggtcatgggacctcaggaccttcctgcgcgctgctggcactcatctccccaccttggcgactactccatagtcaagtcccacaacgacaagaacaagaagctggaggaaggcagccccgggtacaacccccctgaagaggcgccagtgaagtctgtggggcggagggtcctggacgggctgaagcactgttaccacagcttcagccttctctggatggacaccaggacagccacacactcgctctgggggattctcagtggccatatgctgacccaccgggagcacaggcagtttgtccgtgtccgtgctgacctcttttgcctggtcccgctcctcatctttgcagtggtgcttttcatggagttgctaagatccgagagacaggaaagacctaacaatgaagaaatcatgcgctttcccaaattatttgaggatgagctgaccttggataacctcacctgccagcagctgctcaaatccaccttgcagactcttccagagacagtggtgaagggagcccaggtgaaagtggacaaggttaaggaagctatcccaagaaacgaagtggaagaagccacccctgagaggccagtggctgaccagcagccagaagtgcctgatgttatcctgccctcagaggccctgaaggacactgcccctgtgctggagatcttgaaggaggagaaaataactaaagaagaaatgggtgtacttagcgatgcgtgttctaaactgaaggagcaaaataagtccctaaccaaggagaaggaggagctggagctgctgaaggaggatgtccaggacgatagtgatgacttgcaagagatcaagaaggaagtttcaaagaccagcaaagaaaaatatgtggaaaaatctaaagccagcaagacactgacaaagagagttcagcagatgatctggtggatagacagcttgatcgcacagctggagatggatcagaggcctggcaagctgggccaggcagaggactcagggggagcgggagagaaagtcatcggtatcactgagctcatcagtaccatgaagcaaatcaagaacattccagaaaacaagctgatcagcttggcctcaacactggataaaagtaagaatggcaaggtcaacactgacaagctcattaaggtgattgagcttgtggacaaagatgttcacatctctaccagtcaggtggctgagattgtagcaatgctggagaaggaggagaggtggaggagaagaagaaggctaagggaaaggctgaggaggaggctgcagaagtgaagaattagggctggtttttgctctcaggcatgttggtggcccgacaggtgtctgcctccatcctgcttcactagctgttgtggtaatgaccataataataatc

SEQ ID NO: 461334 - DNA, 2214 bp, Homo sapiens
cgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagacctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactaactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagaactggtgtgggctgcaaccagtgtgtgtgggggggtggggattgagcccctccaagaagcccatggggaggcc

SEQ ID NO: 461335 - DNA, 2127 bp, Homo sapiens
cgcccagcggcagagcccacaaaactgccactggccgccaccgggttcctccacctccttcccgatctcaggctggagaagtggtgcaggggtcgctgcgaaaggagaggagcgtgtatgacgccacatccggcgcgcggcggaactggcctcctttgcttccgcggcggggccggaagtaggagcggcggcggcggcggcggcggcggtcgaaagcggagtgaaagagggaggcagggagccggagagccggaaccggagtcgcagcggcggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccagagagatcttggtagaggagagcaacgtgcagagggtggactcgccagtcacagtgtgcggcgacatccatggacaattctatgacctcaaagagctgttcagagtaggtggcgacgtccctgagaccaactacctcttcatgggggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagacctggatcagattcggacaatcgaccgaaagcaagaggtgcctcatgatgggcccatgtgtgacctcctctggtctgacccagaagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactaactgctaccgctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtgggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacacaggtctagatctgggcctgggtctcctagcaaagcctttgctcacccagccccgcccagggccaaacacaggagcccaatgtttcctgagcatggatggcttttgagttttattaacaaaaatactctggtcccagaacaacagaactggtgtgggctgcaaccagtgtgtgtgggggggtggggattgagcccctccaagaagcccatggggaggcc

SEQ ID NO: 461336 - DNA, 1411 bp, Homo sapiens
agcgtgggtcaacaaggggctcacaggacacaacgacgtgcttagtaaaccgggggacactcacaaccaccgggggtactcaggacaccagggggtgcccaggaaaccagggagcactgaggacaccactgctcccttaggaggcagctccacatcagaatcaggaaaagtttgtcttttaagctcttcacagttgttaacaattgagtatggtatactttactgataaaaaaataaaaacataatatcttcttatttacataatttctccaaaatttggaaactgtgttccctcccacacctccaatagtctccactattatcatcatcttctagatcttctgcgatgccctggagattaaggatttgattccatgacagagaggaggtgcatttcgatggaactttggtgaaaaccttggtctttatcccatttcctctggggctccaccagtgcctctggaatcatggtttcagtggcttgcccctgcatggtgtgcaccctcaagagtgtacgagtggttgaggtatggctgctggaattggccaagactccgctgttgttacaggcgcatgctccgaagttggcttttcaatctcgtccacctattcagagaataaaaactagtctaaagaaatatgaaaacatcagtacttttataaagaaatggtagaagaaaaggagaaaaacaaaaatatatctataaaagagcaagaggaattctgaggtgtccagtgtgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagacacagtgaggggaatgttcctgctccctgtaaagtggggatgtggctcttgctgccaaagctccaggtctcaagcccattccctgcagctcaggtggggctcaggctgtggctcctgcagccacgtggaagaggctgatgggactttcctctctcccattgctcagcaccctccagtgtgtcacgtggagactcacctgcgaatggaagtggccaacagtagtgaaggggatgagcttgtgtggacaaaatgggatgtggatgtgaaatttatcctgtgctgtgcaaagtagcacagagtgagtcaccttcctcaccagtagtgttagaaagagggtgtgaaagttgtcagaatcaaaatagatccacttgtgttaaaa

SEQ ID NO: 461337 - DNA, 1242 bp, Homo sapiens
ctcaactccaaaattgatctaatgaactttcccaaaccacattcccttcttgcatttctgagagaatggattcccattcatctgactacagtgctaccctgaaagcagatccagagactaagattcacctgcaggtgattcatttgggtctcaactcaagcattcctttctcaagaagccttttatggtatgaagagtgagacagagttccctgcgccacctccattgaatcatgttaggccttaatgtacctttcctttataacacttactgaatgattaatttggcatttatttacctggctattttattcagtgtttaggatttatactagattgtaagctcctcaagagtgttccaggtctagtttaggtcaccatgtatccctgattagtaccacacatcccagtgcaccatggttctcaacaaataacatgttatataaatcaataaatgacaggaacaaagatgtttttcaatttgtattacaatgttttctactatctggcagaatcttaatgatactggatttaggactgaaaatgtaagagaaaggggttctatgaagtccaaggatataaagacagaagtcagttatggcaaagaatttacaaaacgcttcaaaggcttatctatctcttcccttctttctacaattctgcacatgtgccagccccaaggattctgtacttatgttgagatttttggatcaatatctgttttacaaggtaagctgtcatcagttggaggtaagcagaagacagtagagagtacagagccctggactgtgactcagaggatgagcaccagatccagtttgctgtgccacagtgctcagcatgatgtaaactccactgcggacagatgcagccaagaagacaggtcaccttctaccaactcccaccagaggaaactcttccccaggacccagtacgttggccctctgaccctgcacacagcacatgatgctgaggttcagtgctgaacaagagctactgagagccagagattcacttcttccatggagccccactcatggatggaggctctgtcccgggtccagtgccactgggaacactgggtctctggtttctagctctgtcctatggcagaggttccaccccacaataaccgaagtgctgagaaggtgggaagctcctgcccgaccctccactgagagctcagctcctaggctgaggaataaaacagctcaactttgtctacacctgcagaaccttgttt

SEQ ID NO: 461338 - DNA, 1008 bp, Homo sapiens
gagtacagcctcttcgcctccaccatgctgtatgtcatgtggaagaatgtgggtagattcctggcctccacccctggccacagccacaccccaacccctgtcagcctcttccgggagaccttttttgctggcccggttctgggcctgctgctcttcgtggtggggctggctgtcttcatcatctacgaggttcaagtgagcggggacgggagccgcaccaggcaggccctggtcatctactacagcttcaacattgtctgcttgggactcaccaccttggtcagcctgagcggctccatcatctaccgttttgaccgccgggccatggaccaccataagaaccccacgcgcactctggacgtggccctgctgatgggtgccgccctgggtcagtacgccatctcttactactccatcgtggctgtggtggcgggcacaccccaggacctgctggcagggctcaacctcacccatgcactgctcatgatcgcccagcacaccttccagaacatgtttatcatcgagagccttcaccgaggaccgcccggggctgagcctcacagtacccaccccaaggagccctgccaagacctcaccttcaccaacctggatgccctccacacgttgtccgcctgcccacccaaccccgggctggttagccccagcccttcagaccagcgggaagcagtggccatcgtctcaacccccagaagccagtggagacgccagtgcctaaaagacatttctctgtttctcctactctgcaatgtcattctgtggatcatgcctgccttcggggcccgccctcatttcagcaacacagtggaggtggatttctacggctactccctctgggcggtcatcgtcaacatctgcctccctttcggcatcttctaccgcatgcacgctgtgtccagcctgctggaggtctacgtgctgtcctgaggcctccaacagaggcatggggggcaggaagagggggctcagctcatgtgcccactcagacac

SEQ ID NO: 461339 - DNA, 249 bp, Homo sapiens
atcgctcggcccgatttcactggttgatacatataaaacacagaaccaggcccaagcattgttagtgtttattacaggccagcactttggatttagaagacatgggcagagaggcttggagagattcatcagtccaattgctgcccatgcaggtccaggaactcaagttcagagaggcccagagcctgtgtaaagccagtttggtgacaggctcagagaagactctgactctttgtggacagtggacat

SEQ ID NO: 461340 - DNA, 908 bp, Homo sapiens
gcacagacaaccctgacttttggaaaggctgcagaaatgcagcagcagctgacttgttgaatgaatgcgtgtttacttctctccctgaagtttttcaacaatccttacagtaaagagaaggggaccagtctccaatggacaattggtgctagaagtattcattgtttaccacctgttcaatatgtcgagaaactgcaattcctattaagaacacttgactgtttactcagcacgagaacgtcagccccagcctgcatcaatctaaatgcgtttcgagacgtcaggcccccgaaaagtgcagacggaagaaatcagtctcagagagttcaagagaactttcgcagactcacagagcaaaaaagaggagaaaaatccaaacctatgtttcttgatgggaagcaaactgagtgtggtggaaagaacacaaactttagaatcagtctcccccggaccaaccctgggttggttctgatgacactagcacacttctgcaagtctcagttctgcgtgtgccaagcagagttggaattctggctcggccacttcctggttgtgaccttggatgaattccttaaattcttggtaccccacctgtttcctcacctgtcaagtggagagattcctcaccaaatgaagagactaacgctacatatctccctgggtgttgtgagggttaagtgagttgatacatataaaacacagaaccaggcccaagcattgttagtgtttattacaggccagcactttggatttagaagacatgggcagagaggcttggagagattcatcagtccaattgctgcccatgcaggtccaggaactcaagttcagagaggcccagagcctgtgtaaagccagtttggtgacaggctcagagaagactctgactctttgtggacagtggacat

SEQ ID NO: 461341 - DNA, 1779 bp, Homo sapiens
ttggagattattggacttcttagctagaaaaggccttgtggagagcgtgttcaacatatgttaatttcaggagctcataacaaaagctgttacaaaaaagctcactcataaaactgtccaaagaaacttaatatttttgtctttgctgtgggctgtgtttctcaactcctgtgtatgtgtgcgtgtgtgtgcgggtacgcgcgtgtgcacactttcaagttgagagtctggtttgaccctgaacctatgtgaatgtcaagcgtttgcttttcgtatttgatttggttatatataaccttgctcctgtggaatcaagtagcagccttctttttgacaagtcctgagatctgactcaagtctcagtgtttacagtgtaaagatatgacatttattgattttccactctgtgtgccagtccttgtgaagaatgaagcctggcatccaatataggaggaggggcacgaaacccccaggaaactgtttgtgatgagccctggcacaggtgtgggacgatcatcaaactgacatgtttagagaccaagggttctggtgatagcagtgctactgcccctggcttgtaaaacagcagaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggcc

SEQ ID NO: 461342 - DNA, 1470 bp, Homo sapiens
gcattgtagataagacagaagggtggacttcgtgagaacctggcttgctttcccattcccaaccagaagtgacttggagggaagccctgagtctggagctgcataaccaataaggagctgaaggagaaaaatgccgaactacaagaaaaacttcgactggtagaaactgaaaagtctgagatccagctccacatcaaggagctaaaaaggaaactggagacggacaaaatcccgctgccacaggttcaaaccaacactttgcaggagaagatgtggaggcaggaggaggagctacgggatcaggaggagctacgggatcaggagaagctacggaagcacgaggagaagatgtggagacaggagcagaggctgcgggaccaggagaaggagctgcgggagcaggagcagcagatgcaggagcaggaggagcagatgcggaagcaggaggagcagatgcggaagcaggaggagcagatgcggaagcaggaggagcagatgcggaagcaggaggagcagatgcggaagcaggaggagcagatgcggaagcaggaggagcagatggggaagcaggaggagcagatgggggagcaggaggagcagatgcggaagcaggagaagcagatgctgaagcagaaggagcagatgcggaagcaggaggagcagatgtggaagcaggaggagcagataggggagcaggaggagcagatgcggaagcaggaggagcagatgtggaagcaggaggagcagataggggagcaggaggagcagatgcgaaagcaggaggagcagatgtggaagcaggaggagcagatgggggagcagatgaggaagcaggaggagcagatgggggagcaggaggagcagatccggaagcaggaggagcagatgggggagcaggaggagcagatgcggaagcaggaggagcagatgggggagcaggaggagcagatgcggaagcaggaggagcagatgggggagcaggaggagcagatgaggaagcaggaggagcagatgggggagcaggaggagcagatgggggagcaggaggagcagatgcggaagcaggtggagaggctgcaattcaaggaggagaggctgtgggatgagtatgagaagatgcaggaggaggaggagaagatccggaggcaggtggagaagaggcgggagaagaaggagaggatgggagagcaggagaagacgcaggaggagcggtgctcagagccctgcctccctccctccaaatatccttctgatatgagccaccctggcagcctggagcctgcacgagaggccgggaagggttattcccatgacaaccgcactgcacagatcatgcagctgccccctggaatgaagaacgcccaggagcgcccaggcttaggcagcacctcctgcatcccattcttctacggaggagacaagaaaaagatcaagatcatcagtatctaaaaagaacggtcaacaaggcct

SEQ ID NO: 461343 - DNA, 1872 bp, Homo sapiens
aacatggtttctttctttgctcacgacatgaccgctgggtttggggggcactcagatgtagaggccccagtctccacttgcttttcttgtctcccaaaggcccaggatcataccatacgaatccttatgtgtcagaaaactgaactggagacagcgctccatgacagccaggatgctgccaggaaatttgaagaagattccaaggatctggcagcccgcctgcatcattcctggcactttgcaggagagttacagcgggctctctctgctatgtccgcagagcacgagagggcggacaaggatgcagtgtcctgcccagaagacagcatgggccatttcttgctgcttttgtgcgtggttgttagaggcaggttggggctgagtcagctgctgtggctgctcctctgcctgctgtatcctgacttgacctttctctgtttgcagtacatcaaggagttaacaaaggagagggaagccatgagtctggagctgttcaggaacatcataaccaataaggagctgaaggagaaaaatgccgaactacaagaaaaacttcgactggtagaaactgaaaagtctgagatccagctccacatcaaggagctaaaaaggaaactggagacggacaaaatcccgctgccacaggttcaaaccaacactttgcaggagaagatgtggaggcaggaggaggagctacgggatcaggaggagctacgggatcaggagaagctacggaagcacgaggagaagatgtggagacaggagcagaggctgcgggaccaggagaaggagctgcgggagcaggagcagcagatgcaggagcaggaggagcagatgcggaagcaggaggagcagatgcggaagcaggaggagcagatgcggaagcaggaggagcagatgcggaagcaggaggagcagatgcggaagcaggaggagcagatgcggaagcaggaggagcagatggggaagcaggaggagcagatgggggagcaggaggagcagatgcggaagcaggagaagcagatgctgaagcagaaggagcagatgcggaagcaggaggagcagatgtggaagcaggaggagcagataggggagcaggaggagcagatgcggaagcaggaggagcagatgtggaagcaggaggagcagataggggagcaggaggagcagatgcgaaagcaggaggagcagatgtggaagcaggaggagcagatgggggagcagatgaggaagcaggaggagcagatgggggagcaggaggagcagatccggaagcaggaggagcagatgggggagcaggaggagcagatgcggaagcaggaggagcagatgggggagcaggaggagcagatgcggaagcaggaggagcagatgggggagcaggaggagcagatgaggaagcaggaggagcagatgggggagcaggaggagcagatgggggagcaggaggagcagatgcggaagcaggtggagaggctgcaattcaaggaggagaggctgtgggatgagtatgagaagatgcaggaggaggaggagaagatccggaggcaggtggagaagaggcgggagaagaaggagaggatgggagagcaggagaagacgcaggaggagcggtgctcagagccctgcctccctccctccaaatatccttctgatatgagccaccctggcagcctggagcctgcacgagaggccgggaagggttattcccatgacaaccgcactgcacagatcatgcagctgccccctggaatgaagaacgcccaggagcgcccaggcttaggcagcacctcctgcatcccattcttctacggaggagacaagaaaaagatcaagatcatcagtatctaaaaagaacggtcaacaaggcct

SEQ ID NO: 461344 - DNA, 2129 bp, Homo sapiens
gggacacaacctctctctggtcacctccaaggctaaagaaggtggcagatttagcctccaaccacaagattgtccatcctgaccaggaagtgacatgtcacagagggtggagcagcccatgtggtaggaaatggcccagcttggctctgccttctgcagtgtgagtaacacactgaagccagaagctgtgggctgtggggaagtggctgcatcgccacccaagggaccctggactttgccagacgtcagggttgagaggagccactagcaccatcccagagctgtcagcaccggcctcagcccaggcggctctctccctgagcttcctgtaccctgaccctctccagcctcagacctgagacagggctggacaaggaagcagagagcagaagaaaagcagaagcgaagctcagatctgctgggaggagattacattttgtcccctcctggggtcttgcacagtggcaggtgacattcgtgttacaggaatgactgccagggcctgggcctcgtggcggtcttcagctctgctcctcctgcttgtcccaggctattttcctctgagccaccccatgaccgtggcgggccccgtggggggatccctgagtgtgcagtgtcgctatgagaaggaacacaggaccctcaacaaattctggtgcagaccaccacagattctccgatgtgacaagattgtggagaccaaagggtcagcagggaaaaggaatggccgagtgtccatcagggacagtcctgcaaacctcagcttcacagtgaccctggagaatctcacagaggaggacgcaggcacctactggtgtggggtggatacaccgtggctccgagactttcatgatcccattgtcgaggttgaggtgtccgtgttcccggccgggacgaccacagcctccagcccccagagctccatgggcacctcaggtcctcccacgaagctgcccgtgcacacctggcccagcgtgaccagaaaggacagccccgaacccagcccacaccctggctccctgttcagcaatgtccgcttcctgctcctggtcctcttggagctgcccctgctcctgagcatgctgggtgccgtcctctgggtgaacagacctcagagaagctctagaagcaggcagaattggcccaagggtgagaaccagtagcatctgctgtccatcaaggccctgtgctgcaacagagcccctctgggggactggaatgacctcctgaccactccctcccgggctgctctctccacatctcctggaatcctttgtgagcctccttcagccttttccctgtgcccgatcctcatgtgtcacatgtgaacctgacggacatggacgccctgagctgtgagtccacgtctcatgtgcacgccccggccagctaagcctcgggccgtcagcaatacctctgagtgcccggatgccctccctgcacccttccatttctccaggagcctggcactgcttcctccaccgttttcacagggagaagcaggtctaggactcccctgcacctttgccaccataatggcccacactccctgggtccaggagtgtagaatatgcggctgcttccatttgctgagtgtgtcgattcaatgatgctttcaaactttaataaatgacaatgtgtaggtttgggatgtatcaggcccactcagtcagacctgagtgagaaatccattgttccctgatttccacaggcctttgctgagaatagtggaccaagccccatgttaggcctctcggaatgggggtccctgcagaaaaggatccagaatttcccccaaagcctgactattccctccttcaggtagacacatcctggccagtgtctttaggtccctctgggagagctggtagaagattctcagtgtgaactgtggtagcataaccaggcctacccttcctccttcttcaaggggacctgacctctccttcattccagggctgtgggttttaactggtgcaaatttggaaacggatggagggctatgactccttgatgtggtagttaaatgcttatgggagcttttggtgtatcagacactgacctggcattggagtccagccgtgaacacccaggcaaggagctctgtttacactgagcccatattccag

SEQ ID NO: 461345 - DNA, 908 bp, Homo sapiens
gggacacaacctctctctggtcacctccaaggctaaagaaggtggcagatttagcctccaaccacaagattgtccatcctgaccaggaagtgacatgtcacagagggtggagcagcccatgtggtaggaaatggcccagcttggctctgccttctgcagtgtgagtaacacactgaagccagaagctgtgggctgtggggaagtggctgcatcgccacccaagggaccctggactttgccagacgtcagggttgagaggagccactagcaccatcccagagctgtcagcaccggcctcagcccaggcggctctctccctgagcttcctgtaccctgaccctctccagcctcagacctgagacagggctggacaaggaagcagagagcagaagaaaagcagaagcgaagctcagatctgctgggaggagattacattttgtcccctcctggggtcttgcacagtggcaggtgacattcgtgttacaggaatgactgccagggcctgggcctcgtggcggtcttcagctctgctcctcctgcttgtcccaggctattttcctctgagccaccccatgaccgtggcgggccccgtggggggatccctgagtgtgcagtgtcgctatgagaaggaacacaggaccctcaacaaattctggtgcagaccaccacagattctccgatgtgacaagattgtggagaccaaagggtcagcagggaaaaggaatggccgagtgtccatcagggacagtcctgcaaacctcagcttcacagtgaccctggagaatctcacagaggaggacgcaggcacctactggtgtggggtggatacaccgtggctccgagactttcatgatcccattgtcgaggttgaggtgtccgtgttcccgggtgagcccctccttttctca

SEQ ID NO: 461346 - DNA, 1114 bp, Homo sapiens
ccggtcttctttgggtttgttggctcaggaacccaatctgcatgatcttgtttatagccagctacaaacattttgcagcgttttactaaacgtttgtgaagtgttgtcatataaaacatctcttatgatacttacagaagtcccgaggtagacagaagacttacctagtatactctttttatggacaagaaaacggagaaagtttaaagagacttgacccagcttaacaaaaaagcagataaagccaatgcaagagagaagaagaaagtagatcataagagatcatgttaccatagaggaaagggagaagagctgcactggttcataacttttcagttcctggttccagttcataatgaggttcaaccggacttcctatccttagggtctgatggaaggctttctcatttcacagctgacagcactggagacagagcaggatcacagaagaagaaaataatgagaccctcaactggctctgagaaagcaagctatcatcttgtgaaatgccctgtggaaaagcccatgtagcaaaggacagccaatagccaacagaaagctgatgccctcagtccaacagcctgcaagaaactgaattctgccagcaaccatgtgagattggaagcagattcttccgtgcagtcttgtgagagattatgaagcaaaggactcaagttgtgcccagattcctgacccacagataccgtgtgataataaatgcatattgtcttaaaccaccaagtttcctgggcaatggaagtgagaccgtcaaaaaaaaaaaagagggagaagaaggagaaggaggaggaggaagaggaggagcaggaggaggaagagaaggaggagaaggaggagaggaagagaggaagaaggagaaggagaaagagaagaagttgatatggtttggatttgtgtatccacccaaatctcacgttgagttattcaatgcaaaccctatcaaaataccaataacattcttcacagaaatagaaaaaacaatcctaaaatttatatggaaccacaaaggaaccagaatagccaaagcaatcataagcaaaaagaacaaagctagaggcatcaaattatattacaaagccacctgacttcaaatcat

SEQ ID NO: 461347 - DNA, 875 bp, Homo sapiens
aagcatctgctgcagaagcatgttaagaagcactgatattttcatgggcacagccacctcctaatatgtggttttgcttctctgcaagcatggaatcccctctgcagttatgtttgcctgtgcatctccggcagctggaggacttatcacatcaggctgatgagtgtgtcacgctcttcatcccccaagagctgtgatgaagaccaagacaaacagtagattaacagtgctaccttttataaggctgattagttcctaaaatatgctgaaaggaaacaaaaccaaaaagaaaaaagagtggaaaggggggctggccgacgcagttacagatgttgagggaccagtgataaacaagatgtgtccctctaacatagaaatgagaacactgaccagcaaaaaagttatggggactgaggaagaacagaaccagagtgtgaagctgtttgtaattctgcagcccatactatgcctttacactgtgcagcttctcttgcctggaaagatctttgacttcacttgtgaggtggaagacactggcatttctagactaaggagtgacatgacatgtgccggagccttggaaatgcaagttcaatggctggttggttatttggcttcttgggtgtcacaggcacaagtgcacccctacacccctctaggcaaccacaagactctttctctggccagaattaattattgggaagacaacaccctagattaggagaaagtgaacaggccttacagcataaataatttctaaacttagtcttgactagactttatatctccttaaagaaaattattgatagcataaattagatctcccaaacatacagattatttggcagtgaattagatgatctggggagataatc

SEQ ID NO: 461348 - DNA, 1190 bp, Homo sapiens
aagcatctgctgcagaagcatgttaagaagcactgatattttcatgggcacagccacctcctaatatgtggttttgcttctctgcaagcatggaatcccctctgcagttatgtttgcctgtgcatctccggcagctggaggacttatcacatcaggctgatgagtgtgtcacgctcttcatcccccaagtgagtgcactcccaggcccacctttctggaaaatgttctttggtgcagggtgcatggtgggccagggaattgtctgggcttcccattaatctcagaggatgggagggtaatcccttcacaaatatgggaatgggggctgctctgaggctggcaaataataaacaatgagggtttcttttttttctttttaatcctggattcctccagccctcctctctgtagtcctcagcaataacttagcccttgtcttcctctctgaaggatttaaatggaatgaccttaattctcgctttgtttgcactctatctcttaaggagctgtgatgaagaccaagacaaacagtagattaacagtgctaccttttataaggctgattagttcctaaaatatgctgaaaggaaacaaaaccaaaaagaaaaaagagtggaaaggggggctggccgacgcagttacagatgttgagggaccagtgataaacaagatgtgtccctctaacatagaaatgagaacactgaccagcaaaaaagttatggggactgaggaagaacagaaccagagtgtgaagctgtttgtaattctgcagcccatactatgcctttacactgtgcagcttctcttgcctggaaagatctttgacttcacttgtgaggtggaagacactggcatttctagactaaggagtgacatgacatgtgccggagccttggaaatgcaagttcaatggctggttggttatttggcttcttgggtgtcacaggcacaagtgcacccctacacccctctaggcaaccacaagactctttctctggccagaattaattattgggaagacaacaccctagattaggagaaagtgaacaggccttacagcataaataatttctaaacttagtcttgactagactttatatctccttaaagaaaattattgatagcataaattagatctcccaaacatacagattatttggcagtgaattagatgatctggggagataatc

SEQ ID NO: 461349 - DNA, 2724 bp, Homo sapiens
  misc_feature (4)..(4): n is a, c, g, or t
  misc_feature (6)..(8): n is a, c, g, or t
  misc_feature (11)..(11): n is a, c, g, or t
cgtntnnntcncagcaccgtgctttgggaatcgagtgatggtgctgagtgaacccctgagtgaacatctgtggcttcctcccacctcgtctctggatgcactcctgttcgaatgggtgtctgtacatgcttgtcccctccccacggtggcgtgctcaatggtggctccccacagatatgtccgtgtcctaattcccggagcctttgggtctcatgtagccaatgatgtgaaaaagtgaaggatgctgagaggagatcatccagatgtcttagaggataaaaatgagcgggcagatgaagagatactcagggtgaggtttggaaggtgcaccaggcccaccccatggatgtggctcagagagcctgggaaacctgggatgtcgctgctgcttctcttcgtggtggaggagttggaggcttgcgcgtttagagtgcaggtggggcagctgaggctctatgaggacgaccagcggacgaaggtggttgagatcgtccgtcacccccagtacaacgagagcctgtctgcccagggcggtgcggacatcgccctgctgaagctggaggccccggtgccgctgtctgagctcatccacccggtctcgctcccgtctgcctccctggacgtgccctcggggaagacctgctgggtgaccggctggggtgtcattggacgtggagaactactgccctggcccctcagcttgtgggaggcgacggtgaaggtcaggagcaacgtcctctgtaaccagacctgtcgccgccgctttccttccaaccacactgagcggtttgagcggctcatcaaggacgacatgctgtgtgccggggacgggaaccacggctcctggccaggcgacaacgggggccccctcctgtgcaggcggaattgcacctgggtccaggtggaggtggtgagctggggcaaactctgcggccttcgcggctatcccggcatgtacacccgcgtgacgagctacgtgtcctggatccgccaggtcctcctggtcccacaagatgtggccctgagagcagcgccgctgcccccggcccccgacctgcaagaggccgaggtccccatcatgaggacccgagcttgcgagaggatgtatcacaaaggccccactgcccacggccaggtcaccatcatcaaggctgccatgccgtgtgcagggaggaaggggcagggttcctgccaggggaagtggtcgtggcaggtcagcctgaggatctatagctaccactgggcctcctgggtgcccatctgcgggggctccctcatccacccccagtgggtgctgaccgccgctcactgcattttccggaaggacaccgacccgtccacctaccggattcacaccagggatgtgtatctgtacgggggccgggggctgctgaatgtcagccagatctccctggagttcactgacagtgacaactgctggaacacaggctggggcatggtcggcttgttggatatgctgccgcctccttaccgcccgcagcaggtgaaggtcctcacactgagcaatgcagactgtgagcggcagacctacgatgcttttcctggtgctggagacagaaagttcatccaggatgacatgatctgtgccggccgcacgggccgccgcacctggaagggtgactcaggcggccccctggtctgcaagaagaagggtacctggctccaggcgggagtagtgagctggggattttacagtgatcggcccagcattggcgtctacacgcccttcacccacgtcacctgctacccgacggccatccccaggcccttcacccatgtcacctgctacctgatggctgtccccagcaccctcacccacgtcacctgctacccgacggccgtccccaggcccttcacccatgtcacctgctacctgatggctgtccccagcaccctcacccacatcacctgctacatgatggccgtccccaggccctttacccacatcacctgctacccaatggctgtccccagcacccttacccacgccttcaaccacgccacctgctacacgacggccatccccagcaccctcacccacgtcacctgctacacgatggccgtccccaggcccatcacccatgtcacctgctacacgatagctgcccacggatgcgtcctgtacctgtccctggagaatgacctggtgggcattgtggggggccacaatgcccccccggggaagtggccgtggcaggtcagcctgagggtctacagctaccactgggcctcctgggcgcacatctgtgggggctccctcatccacccccagtgggtgctgactgctgcccactgcattttctggaaggacaccgacccgtccatctaccggatccacgctggggacgtgtatctctacgggggccgggggctgctgaacgtcagccggatcatcgtccaccccaactatgtcactgcggggctgggtgcggatgtggccctgctccagctgtcgctgccgccgccctaccgcctgcagcaggcgagtgtgcaggtgctggagaacgccgtctgtgagcagccctaccgcaacgcctcagggcacactggcgaccggcagctcatcctggatgacatgctggccgagactcctgctacgtgagtgcccccggcccgccctgcctgcctgccctgctcccaccgcagagctcagcggtgacccctttccttcccttcctcagggtgactccggcggccctctgg

SEQ ID NO: 461350 - DNA, 4679 bp, Homo sapiens
  misc_feature (3)..(3): n is a, c, g, or t
  misc_feature (6)..(7): n is a, c, g, or t
ctnacnnggtcagatccaggtggacgtgaacgcagtctttagcagagacccagagaaagtaggtctgtatggagagacattgcccacttcaccctccggtcctcctggtcctccctagggagcctctcgccctcgtatgtcaatctgcactctgcaactcctgcgagagccctagcctgcagctccctgttgtgcccaccctacctcgcccccacctcccctggcacctcggagccagatggggccagcgtgcgcgtcccggtagggtaccgcgcaggggcagcgcacggttcggaggaggtagaagaggatccagagcgttgccagcagcatcatcgcagtgagcagcgcgaacacgtcggtgtcgtacacggccaccttgttgaaggctccgccgctgatgagcgtgcaggcgaggagcagcacgttcaccgccagcagcaccgacagcaggcggccacccttcttccacacctccctggggcccgcacgcggcgccggggggctctccttggggccctgggccagctcctcggacatggcggaggcgactggagaaggctagagggatcactgtaggggaggagcggacaaaactccaggtcaaccctgacggctctccttcccccatctcatccctagacttggggactagggagttcctgacccgcagggttggggcttcgggtgctggaggaagcgctgggaaaggggaagagaaaatgcggaacctgcccctctcgctggatgggaagaaaggagaagcggcagcacccggttggacccctccaaggtccccactccccaagtccgactgccctccggcccggggcacccacctggctgggcttggagccggcgctgagctgggggtcaggggacggcgagcgtctcctctctcccacgccgagatggacaggcgctttatacccaggaggacagggtgatttacagctgcgggagtttggctccataaagctctcagtcccgctcacatgatccatctttctccaaggctcgggcgcggccccgcactgcggcacctagagggcaccccgcccctggtgcccaccgcgccctggcgcgcagcattccaggcgcccagagccccgagagctaagctcaagagacgtccaaaaagcctgcgggcaccctgacgccctccagccgcggcgcaccctgaatcctgtgctcctgtgctcctgcctgggatggcaaccccagttcccctctcccccacggtcctcgcagtgatccaagctcccctttcctctatcccaccgccctgcccgcccccgccgccggcccgcgctccgttggactccggggcttgggtgcgaagttccacgcggcacgcggagccgctgccagtcctccagcgccccctgctggagtgcggtcgagggactccgttcaggcggcggcggcctggcccgtcccactcgctgaccgaaccgcggtcggtcacggtgccccttcttaggtccactgtcctggggctcaggacggctcccccaccccgccctccggcacccctccccagctctcggttcgttccactgacaggtggagaaatacggagccacagcgccccaggctctagtgaggacagatctctgactgtccccggactgggcgtcacagtgcgcggccccggggtgggcacttttgaagaggaggacagggccttgcgtgggtcaccctcgtgtattgaggtgcatgcagggtgtttaggacccaggggaagaccgggggcggctccctggacagcgggagatttcgtcccccgccccctccgcccccgcccccgggtgagcgtttcagatgtcttggtagtcgcggctctggcgctccgcaccctccgtctgcggcagcgggggctggcggccccggcccctgcccggccccgtcctccaacctcatgcctcagccctaataccgccgccctcccctgcggggggcctttctccgtgtcccccgcccgccccgtccacttcgggcgccatgaacgaccagtaccaccgggcagcccgggatggctacctggagctcctcaaggaggccacccgaaaggagctgaatgcccccgacgaggatggcatgacccccactctctgggctgcctaccatggcaacctcgagtcgctgcgtctcattgtgagccgcgggtactgcccagtgcctgaacatgtagtaggtgctggagacccctccttcttgccctctccttgggctgctccttgggcccagcatcagtcctggctgcccccacactcccctccccgcccagccaaggcccgacacctcctctcacactcgggcttgccagggctggccctgctccctgcagacacggccctgcctgctgacatgcaagcccacacttcacacacgctcatcccgggctggggcccggcacacaccacccactgccaggactcgtcactcgtccctcctgaatgctttccctgcaggggtgacccggacaagtgtgacatctggggcaacacacccctgcatctggcagcttccaatggccacttgcactgcctgtccttcctggtgtccttcggagccaacatctggtgcctagacaacgactaccacacgccgctggacatggctgccatgaagggccacatggaatgcgtgcgctacctggactccatcgcggccaagcagagcagcctcaaccccaagctggtgggtaagctgaaggacaaggccttccgcgaggcggagcggcgcattcccgagtgcgccaagctgcagcggaggcaccacgaacgcatggagcggcgataccggcgcgagctggccgagcgttccgacaccctcagcttctccagcctcacgtccagcaccctgagccgccggctgcagcatctggcgctgggcagccacctgccgtactctcaggccacgctgcacggcacggccaggggcaagaccaagatgcagaagaagctggagcggcgcaagcagggcggcgaaggcaccttcaaggtctccgaggatgggcgcaagcgccgctcgctctcgggcctgcagctgggcagcgacgtgatgttcgtgcgccagggcacctacgccaatcccaaggagtggggccgagccccgctccgggacatgttcctctcggacgaggacagcgtctcccgtgccacgctggcggccgagcctgcccactcggaggtcagcaccgactcaggccacgactccctgtttacccgccccggcctgggcaccatggtgttccgcagaaattacttgagcagtgggctgcacggactgggccgcgaggatgggggtctggatggggtgggagcgccgcggggtcggctgcagagctcccccagcctggacgatgacagcctgggcagtgccaacagcctgcaggaccgcagctgtggggaggagctgccctgggatgagctcgatttaggcttggacgaggacctggagcccgagactagcccgctggagaccttcctggcctctctgcacatggaggactttgccgccctcctgcggcaggagaagatcgacctcgaggctttgatgctgtgctctgacctcgacctccgcagcatcagcgtcccactggggccccgaaagaagatcttgggggccgtgaggaggcggcggcaggcgatggagcgccgccggccctggaggacacagagctataaccgggggctcctctccccagaccaaaatgaattgcaagttgccacaacctatggtggggtctcgaggtcctcacagttgccagccctgcagcccccttccccaggagcaaggaccagttggggcgactcctttgaaagtctgtctgcaccttgaagctgagggtgtggcctggaggcaccagaggggcaagagaatgttccggaactccagttctgaggggtcttgaaggccctgagccacccattctgagcagccgtaaaggacatgtagacttgggggaggcctgccccagagggagggcaggggcatcggaactggatgagagtgtgggaggtcaccagggctgtgtgcgtgtgcatgtttgtgtgcatgtatgcgtgtgtgcatgcatgtgtgtgtaagtatgtggtatgtgtgagcacgggtgtgtgcttgggtgtgtgtgttcttgcatacatgtgtgcgtgtgtgtgcacgtgaacgcgtgcgtgtttgtgtgtgtgcatgcatgtgtgtgcatgtgtgtgtgtgcatgcatgtgtgtgtgtgtgcatgtgtgcgtgtgtgcacactcacgttgggtggtgtttggtaggtttccctccaggtctgagccccaggtgctgccccttctctcctgttcctcgtccgtttactgccgcagcccctcctggttcttctggtgctggggtggagcaggctctgtgctcccaccactgtaccccgaatccctcctgcagctcattgccacttttgtagagaatgttctctatcagtatcgtacctgtcttgtcctttaatgctttggggatagagtgaagagtggaagggtgggggtgggggcgggagggggtctgctctgcgcttgggtgagtctcctccataagctggtgcctagtgggctctgttttctcagtcaggtctgaggaagggccctggagtcatcttgctccattgcctaagctgctgggccagtttcttctgcc

SEQ ID NO: 461351 - DNA, 257 bp, Homo sapiens
gtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatacacaacagaaccgagcgcagctgaaaga

SEQ ID NO: 461352 - DNA, 2499 bp, Homo sapiens
gtctgaatcacgctgatgtggccccaaccccacctccctccccaccccatgatgtcagaaaaaaccagacagaacaaattggctgaggccaagaaaaagtttacagactatcgtcagtggaacattgctggtgttggtaccagagcaactgacaccaaaaagaagaaaataaataatggcactaaccctgagacaaccacttcggagggttgccattcacctgaggatgtgggtcttggctggccggtctcctgaggacaaggggcacaaggggaggtcgagggaaaagaaggcaagccaccaacatcaggaagccctaaggcgggagatagaggagagtccaaggatctcgccggccgcttgcatcattcctggcactttgcaggagagttacagcgggctctctctgctgtgtccacatggcacaagaaggcagacaggcataaccaatgaggagctgaagaagaaaaatgccgaactacaagaaaaacttcgacttgcagaatctgaaaagtctgagatccagctcaacgtgaaggagctaaaaaggaaactggagagggccaagttcctgctgccacaggaggagatgtggaggcaggaggaggagctacgggagcaggaaaagaagatacggaagcaggaggagaagatgtggagacaggaggagagactgcgggagcaggaggggaagatgcgggagcaggaggagaagatgcggagacaggagaagaggctgcgagagcaggagaaggagctgcgggagcaggagaaggagctgcgggagcagaagaagctgcgggagcaggaggagcagatgcaggagcaggaggagaagatgtgggagcaggaggagaagatgcgggagcaggaagagaagatgtggagacaggaggagaggctgtgggagcaggagaagcagatgcgggagcaggagcagaagatgcgggaccaagaggagaggatgtgggagcaggacgagaggctacgggagaaggaggagaggatgcgggagcaggagaagatgtgggagcaggtggagaagatgcgggaggagaagaagatgcaggagcaggagaagaagacgcgggaccaggaggagaagatgcaagaggaggagaggatacgggagcgggagaagaagatgcgggaagaggaggagacgatgcgggagcaggaggagaagatgcagaagcaggaggagaatatgtgggagcaggaagagaaggagtggcagcagcagaggctgccggaacagaaggagaagctgtgggaacaggagaagatgcaggagcaggaggagaagatatgggagcaggaggagaagatacgggaccaggaggagatgtgggggcaggagaagaagatgtggcggcaggagaagatgcgggagcaggaagatgagcaggagaagcagatgtgggagcaggaggagaagatgcgggatcaggagcagaagatgtgggaccaggaggagaggatgtgggagcaggacgagaggctgcgggagaaggaggagagaatgcgggagcagaagaagatgtggcagcaggtggagaagatgcgggaggagaagaagacgcaggagcaggagaagaagacatgggaccaggaggagaagatgcgagaggaggagaggatgcgggagcgggagaagaagatgcgggaggaggaggagatgatgcgggagcaggaggagaagatgcaggagcaggaagagaagatgcgggagcaggaggagaagatgtgggagcaggaagagaagatgcaggagcaggaggagaagatgtgggagcaggaggagaagatgtgggagcaggaagagaagatgtgggagcagcagaggctgccggaacagaaggagaagctgtgggaacacgagaagatgcaggagcaggagatcaggagcagaagatgtgggaccagaaggagaggatgtgggagcaggacgagaggctgcgggagaaggaggagagaatgcgggagcagaagatgtggcagcaggtggagaagatgcgggagaagaagaagacgcaggaggagaagatgcaggaggggagcaggaggagaagatgtgggagcaggaggagaagatgcgggagcaggaggagaagatgctggagcacggaggagaagatgcagggccaggaggagaagatgcgggagcaggaggagaagatgcagggccaggaggagaagatgctgggagcaggaggagaagatgcggggccaggaggagaatatgtggggccaggaggagaagatgtgggggcaggaggagaagatgtgggggcaggaggagatgcgagagaaggaggagaggatactagatcataaagagaagatgcaggagaggttgccagagcacgaggagcgcagtgcccaggattaggcagtacctcctgcatcccattcttctaccgaggagacaagagaaagatgaagatcatcaatatctaaaagttggcactgtcaacaaggcctacagaagcataagcc

SEQ ID NO: 461353 - DNA, 1985 bp, Homo sapiens
  misc_feature (3)..(3): n is a, c, g, or t
tcnccttagctactcttgcctgaaggaaacccccagccagctgcaaacagcccagtgtcccgcaatggactttgctcctcagaactgctaacttggtgggtgtccccctacaggtagagtgccataggctggaaggctgccctgccccttctctcccatccgaggcatgtggcttctgcccttgctctgctctcgataaatggggaacactgtcttctctccctgggacctggcttggccctctgagctggcagaacaccgcccagggtgaggatcagactcttgtctgtccatcttcagcttggttacttgaaaccaaaataaactgacagcaagaggcagccagggctgggagccaggacgccaggatcgcaggggtgcttattttagcggatgatgttccattgctgggctggagtccgcccaggacttggcgttgactcacagctcagctcccgggggctcttggctggctcttcctcctccactctccttccctccttctggaagaggtgtcactgtcacagaaacatgtgctggtcttggttccccctagacccgactaggctcgagtcagatgcttgaacgctgtccctgcctttgtcaggagagtgtctgtgctttaggacatcagcgtctgatcccatggggcatggttcccactggcatggctttcaatgtgtgaattattctgcccccaaattgccaggtgatctcagagaaggcacagaacctcttggggcctgaactagtaaatgagggctctgaacaccaggatagccaagagtccctccagttagagggaccacaattcccctgtaagacagaatctcagccaaaaggagcttctggtctgataaacccaagaactgggaaatgacttgggactacattcttttgtaaagagtgaggtaaaaaaaaatttagtttgaatctgtttttcttcttttaaatggaaacaaagacaagtggaaagtcagaaaaaagttcacgggtagcacacgagagctgaggagcatgcagctgagaccgcagtgaatatttgtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacagggttttctgatttgctgttccctcctccccactgggtgtctgttctggaggccagggtgagaggtggaggaggatggccacgcagatcagcactcggggcagccagtgtaccattgggcaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccagccccacctcatcctctcagtcacaggactttctaaagcagcgccatccagatatgacaccacccacaactgcaatgcacggatgcaattttaaaggttccaacagccaaaaaagtaaagagaaacagctcgtattgacctccccggccctgtctgagtgctccagcaccaatctcatgatggcctctgcttcacagacaagcttcttgggtcttcctgggacaccctcctgagagtgttcccaactagactgtgacctcctaggggacagagagctgagctgatactgtttatttatttatttatttatttatttatttatttatctccagtgcccagcttagagcctggatcattgtagctacctaataaatgtttttaaacaaataaatacctttgaaaccaataaaaa

SEQ ID NO: 461354 - DNA, 2994 bp, Homo sapiens
ggagggagcggactgtcgcgttcaaagtgtgctcaggtttaatcgagagtttagaggaaccacgcccttatggctttatctggggcaacccttaatgcaactctcacagtgcggactccagaggttaagagctcagtcacgcaagactgctctccacttcagataccagtgacatgtagcgggtcctcagattatccacacttctatccgacttggctacaaattgggagttcccacgacccctcctcaggaatggatggaggtgctttaactgatacaagtctcacagattcctattttagcaccagctttattggagtcaatggatttggaagccctgtagaaacaaaatatcccctgatgcagacagggtcttgctgtgtcacccaggctgaagtacagtggcgcaatcatggcccactgcagcttcaaccttctaggcacaagcaatactcctctcttgcctcagcctcctgaatatgcactctaagggttgtttataaagaaacatgcacagccatatatagaaatggttatgttttatgaacaatataactagtttaatgcatagttataccttattttaactgcctgtgagccacaatttcaggtactttttaatatatatttttgtattaaaattacctcaggagcttagcttttttcttctcttttaaaattatgcagacattaaataagaagttgagtaaacagattcaggactctagaattaaagccagagctagaaattcttaacttataatttttaaggcattgagttagaagttacatatgagacaaggatttgtgggcatgggatgaagggccttacaggatggagagaccatacaggctatggagtgagtctagaaagcatagaacgtgtttagagaacagaaaatacctaattttataagctctataaggtgtatgaatggtagtacaaatggagaaagggtattagagcatttactcattttattcatagtcaacgggtaccctcttcagtggatattggaatttatgttttacagacaaggaaacttagttatgtgttttgcccaggctaataagttatggaagcacaattcaaaataggtctgtagctttggctttgaatacctgggtagtgagtaaaattttcatttcatgtggtggtttttacatagttgtaatccaagcagtaacacttacaggaagattagattgtcagtaatgtgaacagtagattggaggggaagaagcaaagagagccagtcttaattggttggatacttttatttctgtattcctcagtgatgttataaataaatattttgtttttcagagaatgactaatagtagcagctccccaagccttctaaatgacagtgccaagccatattcagcccatgatcctctaacatcacctgcttcatccttgtttaatgactttggtgccctcaacatctctcagagacgaaagagattttgtgtgaagggatgaaatcctgcttatttttgttcagtttatttatctcaatgtattctgttcttaagataacatctaatttaatgttaagttgctgttaatgtgacccattgtaagcatgttaatcatgtttaaactttattttttgatggctttatctaaatttcaaaaattcttccctaatttactcctgattacaaggcaaacttaaaattttcaacatttcataatgggcccaacaatttaaaaagttgaaaatctcttcacattagaaatttaattttatttggaatttagattgatagaccatgtatggatttttgaagtattttataaggactgatgttgtgacaagttgaataatttgatgcctttgagtcttaatgagaatcttgttaatactaataatcatctagagaagatagtcttttttggttaggatcagcaacagctaaagatgttaaagaggttctaaatcttggtggaagttattataaagttataacattgtttcctaagtaatggaagaaagacccaaaatttaatgagagtaataaatgtaaaattaactaaagctcagaaatgaagataaaatatttcaacatatctcattaatattaattttagaataactgatatgaacttaagatacttttaagaaggatctgatcagcagatagtataaaatgaaattcaagaagactgtggtggtgttggcttcacggtgtatagttatccccaaactcgttgagttgtatacattaaatatgtatagcgttttacatgtcaatcagacctcaataaagtggtttaaaaaattcagaaagactagattttcttaagagaaaaaaaagttatgaagactgatataaattatgttaaaacctcatgtacctaatgttatttccattttgagacatggatgagaataagaaggtaattacaaaatgctttttagcaactagaattgatagactaaaatctgtgggtttaatggatttccttataggctcttatcatggataaatttaccctgctttacatacttctcttataaactggaatacttggtttctaaatccgtatgttagcagtgtaataatagagttggacagaaacagacccaggacaatagacaaagcctaacaatgtggaagcaagcagtaaaatgctgaaaagcgaatacaacctggaaatcaagttatctggagctttttatgggaaaacagaaagtctttaaattttcttagataattcactgctcattgctgttgcctagtcactcccagtggcatggatagaaataattgtattggagaaatatttatgtaaaatagactgtgacttggtgcttcaaagatgtgggcattatcaaaaggacagttagttgaactgtgcgtgtgacatgatttatctttttaggaaagagattgtaaggaaagcacaacaaaacttgaaaaaccgactttataagaaagtagattgaattgctcacaagttatttgaaatggtatttgtagatc

SEQ ID NO: 461355 - DNA, 2590 bp, Homo sapiens
tcctgggcgttgctctcccaccccggccgtgacgcaatctctccgcgccgggggcgggacgagcttgacgccatctccgggcgcccggctgtggggggcgctgggtgtggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagctcccatccacctcgctgcagttcattgggtctccttatagccttccctatgctgtgccacctaatttcctaccgagtcccctcctatctccttctgccaaccttgccacctctcaccttccacactttgtgccatatgcctcacttctggctgaaggagccactcctcccccacaggctccctccccggcccactcatttaacaaagctccctctgccacctccccatctgggcaattgccacatcattcaagtactcagccgctggaccttgctccaggtcggatgcccatttattatcagatgtccaggctacctgctgggtatactttgcatgaaacccctccagcaggtgccagcccagttcttacccctcaggagagccagtctgctctggaagcagctgctgcaaatggaggacagagaccacgagagcgaaatttagtaagacgggaaagtgaagcccttgactcccccaacagcaagggtgaaggccagggactggtgccagtggtagaatgtgtggtggatggacagttgttttcaggttctcagactccacgggtagaggtagcagcaccagcacaccgggggaccccggacactgaccttgaggtccagcgggtggttggcgctttagcttctcaggactatcgtgtggtggcagctcagaggaaggaggaacccagccccctcaacctatcccatcatacccccgaccatcagggtgaggggcgagggtcagccaggaaccctgcagagctggcagagaaaagtcaggcccgtgggttctaccctcagtcccatcaggaaccagtaaaacatagacctttacccaaagcaatggttgtagccaatggcaacctggtgcccactggaactgactcaggcctgctgcctgtgggctcggagatcctggtagcatcaagtctggacgtgcaggccagagccaccttcccagacaaggagccaacgccgccccccattacctcctctcacttgccttcccatttcatgaaaggcgccatcatccagctggctacgggagagctgaagcgggtggaggacctccagacccaggattttgtgcgcagtgccgaagtgagcggggggctgaagattgactctagcacggtcgtggacattcaggagagccaatggcctggatttgtcatgctgcattttgtggttggtgagcagcagagcaaagtgagcatcgaagtgccccccgagcaccccttctttgtatatggccagggttggtcctcttgcagccctgggcggacgacacaactcttctctctgccctgccatcggctacaggtgggagatgtctgcatctctatcagtttacagagcttgaacagtaactcagtttctcaggccagctgtgctcccccaagccagctgggtcccccccgagaaaggcctgagaggacggtcttgggatccagagagctatgtgacagtgaggggaagagccagccggcaggagagggctcccgtgtggtagagccttcccagcctgagtccggtgctcaggcctgctggccagccccgagcttccaaagatacagcatgcaaggggaggaggcacgggctgcgctgctccgtccctctttcattccacaggaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaag

SEQ ID NO: 461356 - DNA, 2210 bp, Homo sapiens
cagtcccgcgtcggcccgcccctcgggccgcgagaggcgccgggatcgcgggcgccggctgagccagcggctcttgggaggctgcgtccgcacgccggcggggcgaggcggcccggccctgcgcgtcaggcctgagacctgggaggaagctggagaaaagatgccctctgaatctttgtgtttggctgcccgggctcgcctcgactccaaatggttgaaaacagatatacagatggagtcttgctctgttgcccaggctggagtgcagtggtgccatcttggctcactgcaagctctgcctcctgggttcatgccattgtcctgcctcagcctcctgagtagctggaactatagacgtccaccatcatacctggtgaatttttgtatttttagtagagacggggttttaccatgttagccaagatggtctccatcttctgacctcgtgatccacccacctcggcctcttagagtgcttgggattacaggcgtaagccaccactcccggccgatatattgctttatgaaaattatactggatctgttacagatgatagtgttgaaccaagtggaacaaagaaagaagatctggatgacagagagaaaaaagatgaaactcctgcacgtcgcttcgttcctgcatccactgttttcatttcagggatgttcacggaataccaggcactaaagggccagaatcatccccctacaggaccagcacttggccctggccatcctgctggagctggctgtgcagagaggcatgctgagctgtgggacagcggggcacaggagactgacaatgagcgttccgcccagggcaccagcgccccgcttttgcccttgctgcaaaggttccagagcatcatttgcaggaaggatgcaccccactccgagggcgacatgcacatgagacaggtgtgggaggccacttgtttgtggagaagactcagatcagtgcgcgccgacttccttgtcagcacagaaccaagcttgaaacatgcacttttaaatcaataccagaaaagaacaacgaaaatagtggcttgctttgttggcccttcctttgtactgggctctgtgcagggcatgtcacctgagctgtcactgtgtttagtaccagccccccccttaataggtgtggacgtcttcctgaacagcctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttttgtgctaattttaaaaattactgagatgatttaattgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcgctcactgttgtgtgtattgcgacttcgtttttattattgggaagttttccattttataggtgtagtactgtttgttagttcattttcctattgaaggacatgtaattgtttttggtttttgttttctttttttttttttttttttttttttgagacagggtcttgctctgtcacccaggctgtatacagtgacctgatgttggctcactgcagccttgtactcctaggctcaaatgatcctcccacctcagcctcctgtgttgcagggaccacatacatgtcaccatgtccggctagttttttgatttttttgtagagacaaggtttcactgtgttgcaaggctggtcttcaactcctgggctccagtga

SEQ ID NO: 461357 - DNA, 2829 bp, Homo sapiens
cagtcccgcgtcggcccgcccctcgggccgcgagaggcgccgggatcgcgggcgccggctgagccagcggctcttgggaggctgcgtccgcacgccggcggggcgaggcggcccggccctgcgcgtcaggcctgagacctgggaggaagctggagaaaagatgccctctgaatctttgtgtttggctgcccgggctcgcctcgactccaaatggttgaaaacagatatacagatggagtcttgctctgttgcccaggctggagtgcagtggtgccatcttggctcactgcaagctctgcctcctgggttcatgccattgtcctgcctcagcctcctgagtagctggaactatagacgtccaccatcatacctggtgaatttttgtatttttagtagagacggggttttaccatgttagccaagatggtctccatcttctgacctcgtgatccacccacctcggcctcttagagtgcttgggattacaggcgtaagccaccactcccggccgatatattgctttatgaaaattatactggatctgttacaggtacgattgatgtattttatttttaagttgtcaaacgttcagttaatgatgtgtgttgtaacttttcggggagggacatttgcagagactgacagatggtatggcattctgaaaagcggttacagattaaaaaaattttaattctgcagatgatagtgttgaaccaagtggaacaaagaaagaagatctggatgacagagagaaaaaagatgaaactcctgcacctgtatatggggccaagtcaattctggagagctgggtatggagtaagcaaccaggtaatctttgatcagagatagaaattagtgtagacattttgcctccagatcctcaagtggttttagaaattggttctctaattctgtgggagaaggttgatactggtatagtcttacacgtcattgaaactggaaaagatagctagatattctcctactcatgttttggataatgagataaattattttatgcttcacacacttggagtatgtcatctactgtaatatagtatctgaatgaatactttaaataaaatacatttctgtaaattaattgtatactttaaaaatctgtgaataaatttgagtagcaagtctcagaagcttgattctaaatattaaagatacatccttccttgggagggagcatgtagcaaatgtgttactgtgattgtaagcatgctgtctttctggaggtcgcttcgttcctgcatccactgttttcatttcagggatgttcacggaataccaggcactaaagggccagaatcatccccctacaggaccagcacttggccctggccatcctgctggagctggctgtgcagagaggcatgctgagctgtgggacagcggggcacaggagactgacaatgagcgttccgcccagggcaccagcgccccgcttttgcccttgctgcaaaggttccagagcatcatttgcaggaaggatgcaccccactccgagggcgacatgcacatgagacaggtgtgggaggccacttgtttgtggagaagactcagatcagtgcgcgccgacttccttgtcagcacagaaccaagcttgaaacatgcacttttaaatcaataccagaaaagaacaacgaaaatagtggcttgctttgttggcccttcctttgtactgggctctgtgcagggcatgtcacctgagctgtcactgtgtttagtaccagccccccccttaataggtgtggacgtcttcctgaacagcctgaagcagacggtggtgaccctggcaagcagcgcagacgtgctgagcaccgagcagtcggcctcccaggccatgctgcagagcggctggtccatgctgttgcccaccgctgagaagcaggcccgggcactctgctctcctgccctgcggagtttcaggcaatgaagtgagcataagtccaggtcatcgattggtgattgatcttctggtgggcagcttgatggctgctggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttttgtgctaattttaaaaattactgagatgatttaattgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcgctcactgttgtgtgtattgcgacttcgtttttattattgggaagttttccattttataggtgtagtactgtttgttagttcattttcctattgaaggacatgtaattgtttttggtttttgttttctttttttttttttttttttttttttgagacagggtcttgctctgtcacccaggctgtatacagtgacctgatgttggctcactgcagccttgtactcctaggctcaaatgatcctcccacctcagcctcctgtgttgcagggaccacatacatgtcaccatgtccggctagttttttgatttttttgtagagacaaggtttcactgtgttgcaaggctggtcttcaactcctgggctccagtga

SEQ ID NO: 461358 - DNA, 1840 bp, Homo sapiens
accaaggttgctctgacagcaagaggaccttgatgcctctaaacccctttcccattggcactgtccccaccagctggaataaagagcaaggaccctgtctctgtggatacagccctcctgcggggcccccaaagacaacggatgcttcgtatggtgcaggcctggggacagctcgcctctccctcgcaatacacccacctggggttggctcaaactcctttttgtctgttgctgcagagagtggtggaaagctacagagaatggacaaaactcacagaccatctgttcatcttctgtgttttgtgaatttattttcaaatgttaagcattcgatagcagtcgtcaggcatcatctcaaaacttaccatttggggaaaggcattcttttaaaaatctacaagaatcactcatagaccagtgagagtcagggtttggaataggggctacttgagccaatcgattgctatcctttttttcccttgaattaaaccaatttgaagtgcattttctgccacttgcaactgaaacaaagcctaaatgatactacctggatccaaataccagctctaccattttcacaaaccatactctttcaggccctaagaagaagacagatgaggcttttgcacttgtactccagcatagcaaacaggtatcctaaacatgtgcttgttaccttatgcaacaacatggctgatctgactccaccattaagtcctagttccgggtaggaagaaagccaagagcaaaaggtgtcacctacgtgctagcaaagtctgtccaaaaacctgctgggaggagattttacagaaaacccacagaacaagtttggttttccctttcttaaattttggtaaaatatatataatatttgccattgtaaatgtttgtaagcatacaattcagtggcattaatcacattcacaaggttatgcaatcatcacctctatttctaaaattgtttcatatatctaacaaaaattctgtaactattaagcaataactcctcattcctgtctcctctcagcccctgataaactctaatctactgtctgtctctgtgcacttgcctgtttacgtacctcatataaatggaatcatgccatatttgtccttttgcatcgggcttattttgcttagcacaatgtcttcaagattcatccatgttgtgacatgtatctgaacttcactctttttatggctgaataatattccactctatgtatataccacattatgtttatccatttgtctgttgacgaatacttgggttgttctcaccttttagccattatctacactgcaatttttgattacattgtatcagtcagaattttatgacaaaaccatcctactctgtgaggaaaactgaacaatgtaactttatttcagctagagagagtgtccccagtcacaattggagtcttatgtaagaagaaataaggaaagcctactgggttgaatctaaaagtagaaaactcataacaaggctatgtgtgaacatcaagagagaattcaagatggcggggatgacactctttagtccatgtgtgcctggttttcatcatctccttgacttacacacatgtgggtgcctttacctctgaagactttttctcttctaactgatgatgctccattctcttctgacaaaagctccctgccaaggcctgattgaacctctgccctgtggttccttgaaacatcgtcatattcttgtactaaattccccattttcttaagctagctctggtaagtttttgccatttacagtcaaagtgaactcactaataaaatattcccaactgcataatcttctccctgggggatgggaatcata

SEQ ID NO: 461359 - DNA, 2191 bp, Homo sapiens
ggcagctactgccatggtgagtgccaaggggatacaggatgcgtgtgcaatgcgcacaccactcaaagggcacacagtggcacgcagtcctccagcagaaatgattcacagccaaatacagaagccggctgagcacagaatccaaagacagtggggctccaagccggctgtgctagcggcacaccagctctcctgccttcgtttcctgggtctcataacacactgtggggacttgggccccgtcgcagacaatgaaagagtcccagccagccagcactggagaaaaggagactgcaaatgcagacaaaccttgccaagcttcctccctctctgggtcacagtttccttctgtgcaaatcagagactgagactgaaagagggatgtgctgacagaactaacccagagtgaagattgggtaggcaggagcgctctaactttcaattacagtgtcacaccaaatggaactccgcagctctctctctactctggggtgtatttgactttgaatcaagcgacctcctgaacatatagacacagagaggagtggcttgttcctgctcactcaccccaccaggctgccatgggacataagccacagcccatcgtttacacacaggcttattaaagcaaataggatttggcctagattgcaaacaggttctcctctggacccacctctgcaatctgaaccactttcatttaaggaaacccaaagtcatgatctgttttctaggaaagtcagagccaaagacatgaacagaaaagaaaaaaaatgctgacaagtctcagtgggccaggacctgaaaatcaatttgacacatcaattttttggatttaataactcatgctcccatggaatcaagacctcccctttttaaacttctctgccctcaaattggatggacgctcttggatcatctgctcgaatgtcacgttttcaatgaagccttccctggtctccttatatattaataccccatttacagatgatcttggatcatttacagatccaagatcatctgtaaatggggtattaatccctttctcaaataactgttgagtgagtttaacaatatgattcatctaaaggtgctttgaaatggtacgagtgttacttggtctaattcagtctcagacttctggttgtggaatgcctgccctttatttccatagtctcatatagtgagtccagctgtacactcagggacttgtgtccccatctccacaataacctgcccaggcctgaccccacattccaactctggattttcatcgtgcatggactccttgtatgagcccagcctagttttccaactcacctgtgctccaccctcccaattgctctcttccaactggagagcccacgtgggcccaaggaaggcagggaggaaagtgacattgttgagccctgtgcccggtgaagtacgcatgtgagctcatccaatctgcagccactccaggaggagggcatcattatcctcaataaacagatgagcaaacagaggctcatggagggtcagcgacgtgtccaaggtcactgactcatcagaaggctactttgttctcactccatcaggtggcccaaggagaaagggtggttcacatccaatgattgatccatggaaagacattgaggcctgagcccctttccccagtctggaacaactctgaaggctcattccatttcacatttcccatggcatcagcagtcatttgtacaagtctggagttattttcagtggttaccacctggggattttgctactggcatccaatgggtagaggccaggggtgctgctgaacattctacaatgcacaggatactcccacccacagcaaagaattatctggcttaaaatgccagtaatgcccaggttgagaagccctctgtttgtgctggcaagcttgggccctggcagcatgtgtccatgctgtctgttcttgttgtcactagttctggttttcagaccttttcatgctcttttctattttggtttctaacaagggacacaggcacacacatgctcagaacaaatgcacagccttccttccccataacccctttctggctgcaatcatattcactgaggattagtcagccctctccaatggaggggagtggacactcaccttgacatcctgtgggcgcctgcagatgctggctctttctctcctcccagggataagacc

SEQ ID NO: 461360 - DNA, 523 bp, Homo sapiens
tgcttttagtattatgtctggcaatagtctcctatcccaaaattatgtcaatatatacttatgttttctttcagtatgtttatgatgttattttttaaaacatttaattctttagtccaggtggaatttattttgattgtggtaggaattgaacctttccctcaaattgttaagcagtcccaatcactgattttaaaaacattttccctaaatgtttaacatttctccagttaaaccttagattgacttgggtctgtttctgagttgttctcctccattggttcgtgagtggcttctgctgctggctccatactgttcccacgactgtcttggaggcacattttagggtctggtaaggcaagtaccccccacattacttcacaagttttctgactattttcactcgtttattcttccagatgaaatttagaatcaagttcaaaacaaaaaactctttggaattttgattgtgattttgcttaaaattagagattactttggggagaatagtggtctttgcaat

SEQ ID NO: 461361 - DNA, 346 bp, Homo sapiens
ggtgggattacaagtgatctttattttccttacatttaaaaaaattcaatgtatttttacaaataataaaatatgttttaaacaatcattaatacctttttagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggtgggtacgctcagagcagctttcttttcttttctcttccagagatttattcttgt

SEQ ID NO: 461362 - DNA, 1940 bp, Homo sapiens
agcgaggccgggccgccggcgtttgaccgcgcttgggtggcctgggacccggtgggaggcttccccggcgccgagagccctggctgacggctgatggggaggagccggcgggcggagaaggccacgggctccccagtaccctcacctgcgcgggatcgctgcgggaaaccagggggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggaaagaataacacggactacacgttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcaaaaagaaatggaacaggatgtgaagagacttggccaggctgcctgggccacagcaattcccaggttggaaaaacttaagctaatgctagctcaagagactctgcaactcatgagagcgaaagaattgtatttaaattgcaaaagagctgaaattcagggaaagatggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagttaaaccttagattgacttgggtctgtttctgagttgttctcctccattggttcgtgagtggcttctgctgctggctccatactgttcccacgactgtcttggaggcacattttagggtctggtaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcaaagaaaatcattggctcagattgcaacaggctgaagaaagcataagatattctcgtcagcatcacagtattcagatggtgagtgtcctccgaaggaaaatgttctatgtttgtgtagcgtgacatgcaggcctagacttgtggaaactggagttgcgctgccctggacctgcagctgtcagccaattcacctccaggcctgcagtctggttgcagtcttggggtggtaatgttggggtacagcctctttctttgtcaagacatttttattgtatgccacgacatttttgtaatgttgagcaatttacaaatatacatctgcttaaatatagaaaagagacaagataaaaaggagcaaaagaaaaaagaatgggtcaaccaagaacgtcaaacactccaacgattgagagcatttaaagatcagttactgataccttgccattgaaggggaggatagatgcccacagcccctctccttcaaccacatatgtccaagtaaaactagtatttcttctttttaaaaagatagacataattattttccgtattattgaatacatttctgttgtaacctcagttctactcttcagaatcctttgttc

SEQ ID NO: 461363 - DNA, 776 bp, Homo sapiens
actctcatcatagactgtggaggagagtaccattgggccgcaccagaactaatattaatgaatgccttacactacgcccaaatgcagtgctttcttcttttaaccttttatgctataccagggtaacactaaaaaccatgtaggtgatttgtattattccaccaggatcagtgcaaagaaaatcattggctcagattgcaacaggctgaagaaagcataagatattctcgtcagcatcacagtattcagatggtgagtgtcctccgaaggaaaatgttctatgtttgtgtagcgtgacatgcaggcctagacttgtggaaactggagttgcgctgccctggacctgcagctgtcagccaattcacctccaggcctgcagtctggttgcagtcttggggtggtaatgttggggtacagcctctttctttgtcaagacatttttattgtatgccacgacatttttgtaatgttgagcaatttacaaatatacatctgcttaaatatagaaaagagacaagataaaaaggagcaaaagaaaaaagaatgggtcaaccaagaacgtcaaacactccaacgattgagagcatttaaagatcagttactgataccttgccattgaaggggaggatagatgcccacagcccctctccttcaaccacatatgtccaagtaaaactagtatttcttctttttaaaaagatagacataattattttccgtattattgaatacatttctgttgtaacctcagttctactcttcagaatcctttgttc

SEQ ID NO: 461364 - DNA, 334 bp, Homo sapiens
aatgccagaaatactgcaagcaaaactgaaaacaacccatccatgtaggaaagaataacacggactacacgtaagcaattccaagtctgtgtctgcggggacgtcgcaagtgggataaaatggtttaaaggaagaaatggcttttaggagttagggtgttttgttttaagtaatacagacttggtcaaatggaaagccggtagaaagtgagctttattcatcagtttagaataaccgcattagtgcccttttaagcttgaaagaggtagtttgagagagtaattatttgagtggtaaacttactgaacttaaggggacggggaagtgcatgttc

SEQ ID NO: 461365 - DNA, 366 bp, Homo sapiens
tacctcattgccatttatgtttctcaaaacctaaatgtttttctctgtttcaaggatgggataaagtattagcatcactagatgaaatgaaaaagtgtttctttcctatttgctcttttatatttagtacggaacaaggaatagaaaatagctagaatgcttctaaagtttgtttttaatatactatttgttttaacttatttttcttttttctatgaaaataagatggaagatcttccagaacaagaaaaaaatataaatgttgtagatgaattagaaatacaattttatgaaattcagttagaactatatgaagttaaatttgagatattaaaaaacaaagaaatactgcttactacacagttg

SEQ ID NO: 461366 - DNA, 1813 bp, Homo sapiens
agcgaggccgggccgccggcgtttgaccgcgcttgggtggcctgggacccggtgggaggcttccccggcgccgagagccctggctgacggctgatggggaggagccggcgggcggagaaggccacgggctccccagtaccctcacctgcgcgggatcgctgcgggaaaccagggggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggaaagaataacacggactacacgttattcaaggacaccgaaaagccaacaccatggtagcattaatgaaagtttaccaagaggaagatgaagcctaccaggaattagttaccgtggcaaccacgttcttccagtacttactgcagccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcaaaaagaaatggaacaggatgtgaagagacttggccaggctgcctgggccacagcaattcccaggttggaaaaacttaagctaatgctagctcaagagactctgcaactcatgagagcgaaagaattgtatttaaattgcaaaagagctgaaattcagggaaagatggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcaaagaaaatcattggctcagattgcaacaggctgaagaaagcataagatattctcgtcagcatcacagtattcagatggtgagtgtcctccgaaggaaaatgttctatgtttgtgtagcgtgacatgcaggcctagacttgtggaaactggagttgcgctgccctggacctgcagctgtcagccaattcacctccaggcctgcagtctggttgcagtcttggggtggtaatgttggggtacagcctctttctttgtcaagacatttttattgtatgccacgacatttttgtaatgttgagcaatttacaaatatacatctgcttaaatatagaaaagagacaagataaaaaggagcaaaagaaaaaagaatgggtcaaccaagaacgtcaaacactccaacgattgagagcatttaaagatcagttactgataccttgccattgaaggggaggatagatgcccacagcccctctccttcaaccacatatgtccaagtaaaactagtatttcttctttttaaaaagatagacataattattttccgtattattgaatacatttctgttgtaacctcagttctactcttcagaatcctttgttc

SEQ ID NO: 461367 - DNA, 1918 bp, Homo sapiens
agcgaggccgggccgccggcgtttgaccgcgcttgggtggcctgggacccggtgggaggcttccccggcgccgagagccctggctgacggctgatggggaggagccggcgggcggagaaggccacgggctccccagtaccctcacctgcgcgggatcgctgcgggaaaccagggggagcttcggcagggcctgcagagaggacaagcgaagttagagcctagtgtacttgccgctgggagctgggctaggcccccaacctttgccctgaagatgctggcagagcaggatgttgtaacgggaaatgccagaaatactgcaagcaaaactgaaaacaacccatccatgtaggttattcaaggacacggaaaagccaacaccatggtagcattaatgaaagtttaccaagaggaagatgaagcctaccaggaattagttaccgtggcaaccacgttcttccagtacttattgcggccatttagggctatgcgagaagttgcaactttataagtccttggatgaggatgacctaggtcctagaagggtagttgccctggagaaagaagctgaagaatggaccagacgggctggagaagctgtcgtctctattcaagatatcacagtgaattattttaaggagacagtaaaagcattagcaggaatgcaaaaagaaatggaacaggatgtgaagagacttggccaggctgcctgggccacagcaattcccaggttggaaaaacttaagctaatgctagctcaagagactctgcaactcatgagagcgaaagaattgtatttaaattgcaaaagagctgaaattcagggaaagatggaagatcttccagaacaagaaaaaaatataaatgttgtagatgaattagaaatacaattttatgaaattcagttagaactatatgaagttaaatttgagatattaaaaaacaaagaaatactgcttactacacagttggactctcttgaaagacttataaaagttaaaccttagattgacttgggtctgtttctgagttgttctcctccattggttcgtgagtggcttctgctgctggctccatactgttcccacgactgtcttggaggcacattttagggtctggtaagaaaaacaggatgaagttgtctattacgatccatgtgaaagtccagaggaacttagtcattgactgtggtggggctgcaggacgataagaattcggaagtgaaagaactcagaaggcagtgccagcagctggagtctattaaacggggcaggatctgtgtcaaaagagcttctctccagagtagaaaggatcagtgcaaagaaaatcattggctcagattgcaacaggctgaagaaagcataagatattctcgtcagcatcacagtattcagatggtgagtgtcctccgaaggaaaatgttctatgtttgtgtagcgtgacatgcaggcctagacttgtggaaactggagttgcgctgccctggacctgcagctgtcagccaattcacctccaggcctgcagtctggttgcagtcttggggtggtaatgttggggtacagcctctttctttgtcaagacatttttattgtatgccacgacatttttgtaatgttgagcaatttacaaatatacatctgcttaaatatagaaaagagacaagataaaaaggagcaaaagaaaaaagaatgggtcaaccaagaacgtcaaacactccaacgattgagagcatttaaagatcagttactgataccttgccattgaaggggaggatagatgcccacagcccctctccttcaaccacatatgtccaagtaaaactagtatttcttctttttaaaaagatagacataattattttccgtattattgaatacatttctgttgtaacctcagttctactcttcagaatcctttgttc

SEQ ID NO: 461368 - DNA, 1216 bp, Homo sapiens
gattcacaaacagacctggaatgaatccttctcgctcttcatacactgagacaggttgaaatctaagaccatggcagggagaagccgcacgcggagtcgcactgtcaggatccaggatcgatcttaatcagattgcaagttcttcaggcttggaaccatatcaccacaatgaacagccaagtataaagggtccctggggaaaccccaaccggcctgcgccctgggagaatggggtggagccacggaagttcacgcgctttgcagaggggaggagcctggcctctcctgatcctggatagtacctgagattcaatcgctgaggcgggaaaacccgctagcaggactgttgctttgctgagagtccctgtttccctttttttccttttggcccgataaattccatttttctcacccttcaaaatctctgtgaccctaatctctcatggccatgtgacatgggccctaaagagaaagtcctacaacaatagctttcatatgataatatcagtgataagctgtcgtttacaatggacgcctctcaggaaggtcataaccgaagaaaaccgctgtcagcagtttgggagggaaggactgggtctgaacacacagacaaattatagcaagagccaccaaggtggacgttgcttacccagtgctcatggagtgagtcagagcccaaagtattcttcccctgagcaaagccatctctattgtcagatgcagaagccccagccaggggcccggagatgcctggattcttctaaatcctgcaggtcttcgaggcctcttgcaactgtaattgagtttcctgtcaaagctttagcatgcagcagctcttcgccaggtcttatgccaggccctggggatgaaaggacgaacaagataaccctgccctcagggagcttccagtccaaagaaacccaggaggctcaacacaatgtgatgatttctgtgacgtggttaagtccggggggccataaaaagcggggcctctaaccaggtctgtgggcaggcgagcactggagaaagtttctatgaagagacagcgtatctggatgaaagcacacagaagagtgtaaattagtcaggaatattttttctccaagaagttgtcaccagaaacttaagaaaaagcctttttattgaaatatgcatttaaaaagtgcacaaatgaaaattttacagcttgacaaggccccagagtcagcccatgatg

SEQ ID NO: 461369 - DNA, 1055 bp, Homo sapiens
tgctccagtgcagatcaggaaggagcagggggtgaaatgttacaaattctagaactcagagagctgaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctactgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaattcaaaaacaaacaaaacccacgctccaaaaacaaactaacgaagaataaataaataatataaaaataaaataaatactgcagtccttatgtt

SEQ ID NO: 461370 - DNA, 762 bp, Homo sapiens
ctacaggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccacttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaattcaaaaacaaacaaaacccacgctccaaaaacaaactaacgaagaataaataaataatataaaaataaaataaatactgcagtccttatgtt

SEQ ID NO: 461371 - DNA, 642 bp, Homo sapiens
tgctccagtgcagatcaggaaggagcagggggtgaaatgttacaaattctagaactcagagagctgaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtaagtttgtttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaaattcaaagtgtcagaggttccatatttgtaatagcaaatgggccctgactgtaaattagtgaagagtgaatgt

SEQ ID NO: 461372 - DNA, 1060 bp, Homo sapiens
agggacatttcgtggcctctggatgtgggcagacattataacaaacactgtgacagagggatttctgtaccccggggtttcttgccttggtgtactggaagaagcaaatcacacgtgggcttggagaatgagtgtaaaattttattgcgtggaggtagctctcagcggacggaggatccacaagggagctcttctcaacgaccagctgcttgtgtcttcttcagccgacgtgctccttttgatgtgtggctgcccgctaggatgtgtgtgtggtacggggcggggggtgggggtggagaacggttattataggtacaggatggggcgtggcaggccagggtggtgtcgggaaatgcaacagttgggcaggaaatgtctgtcctcacctaggaaagttacttctggttttgtcaacagttccatcgctgcccagctgacactggtggtcagctgctaatgacccttccgctggagagaagaggaagtgggcttggctctaacttgccctgatccccttccagcctgacatttctatgcacagagaactaatggagtcagaccagactgcaaattcccatgctgccatgcagaagccaggagtatgaaatcaaggtgtcagaggggctgtactccctccgaaggctgcaggagaaaatctattgcttgcctcttctaccttttggtggttccaggagttccttggcttgtgatcacatcactgaaatcttaacctacctggtcatactgctgcctcttcttctctctcaaaacttctcctgcctctcttcatacttgtgattgcatttagggtccatctgggtactccaggaaaaactcctactgtcaagatttaacttaatcatatcttatgtcatataaagtcatgttcaatattttacaacataaaataatagtcacagtttctggagataaggacatgggcgtgtcttttgggggatcatccttcaatccattgcatctatctatcagtgatcaccccaacccaaataaacccgcataatattttcaggtatccatttttcctttttccagggtccct

SEQ ID NO: 461373 - DNA, 912 bp, Homo sapiens
ctgaaggatccctgtggtgtcaggcaggaatggcctgcttgggaagctcacaggtactttgctgctgcttcctctacccctgtatttcactcggctctctaaattgacttggctccagttaaggttggaatcttctgcaaactaggccttgagtttctccagtaggagtgtgtgtttggttaaggaggatttccctttcccacttccacagtttggtcacagtatttggggtgcctcctgggtcctgcgtgagcaatccacttccttaagaggatctgtggatcctatcgggttttctgatttattcctgtggtcgttttggagttaaaattcacaatacggacctcctcacgctgctgtattcatccgtgtcacagctgcaatcttgtcctgcctcccatctgccatgatggaatgcaatctctttatttactattattattattattttcaattttttattttaagttcagaggtacatgtgcaggatgtgcaggtttgttacagagacaagctcaggggctacatgaagaacagcaggttacagcagcagtcaggaccatcagctgcaaatcagttggagtttgctggcggtccactccagaccctttttgcctgggtatcaccagtggaggttgcagaacagcaaatattgcagaacggcaaatgttgctgcctgatccttcctgtggaagcttcgtctcagaggggcaccaggctgtatgaggtgtcagtcggcccctactgggaggtgtctcccaggaacttttacttatgtctaaagatgcagttcaaaagcagccatttccttgaaatgtaaggacttcttctgggttcccataaagttaatatatggattatatcacattgctatgattatttatttgcatattcttttctgttctaaactct

SEQ ID NO: 461374 - DNA, 794 bp, Homo sapiens
tatagatgtatgtcactgtgtttaacatattactattttattttaataaatggatctatagatgccacgcggactatgccccaagtgaacatttcaggggtgcatctgcttttgtggattggtgggatctacatcccatctgttagttctgaccactcattgatggtgcataatgaaatctttctaatatggtttggctgtgttcccacccaaatttcacatggtagctcccataattcctatgggaaggaatcagtgggagagagtccccgcctctctcttgcctgctgccatgtaagacctgactttgccataattgtgaggcctcctcagccacgtggaactggtctcactctgtacccaggctggagtgcagtagagcaatcacggctcactgtagcctcaatctctggggttcaagcaatcctcccatctcagcctcctgagtagctgggaatgcagcaacatggaagcagctggaggctactatcctgaatgaaatactgcagaaacagaaaagcaaatatcacatgttctcacttataagtgggagataaccttgagtacacaaggacttaaagatgggaacaatagacactggggactccagaagacgggaagatgggaggaggaaggaaagggctggaaaactgcccatcttgtactactattatctggatgacgggatcaatagatgcccaaacgtcagcatctctcaatatatccttgtaacaaatctgcacatgcaccccctgaatctaaaattaaaattaaaaagaacattggtaacagaa

SEQ ID NO: 461375 - DNA, 2234 bp, Homo sapiens
ctcccctggggtcttgcccagttcctgctcaccagaaggaccatagccgaggtcctcctcccagggcccggggctggggagcggaagccatcagtgggctcggaggacactgtcccagccaggacacggccatcggtcactaatctgcagcaccggaatgtccccaggccaatcagcgggcccccctcttttgtccaccagcccagcctgactcctggagattgtgaatagctccatccagcctgagaaacaagccgggtggctgagccaggctgtgcacggagcgcctgacgggcccaacagacccatgctgcatccagagacctcccctggccgggggcatctcctggctgtgctcctggccctccttggcaccacctgggcagaggtgtggccaccccagctgcaggagcaggctccgatggccggagccctgaacaggaaggagagtttcttgctcctctccctgcacaaccgcctgcgcagctgggtccagccccctgcggctgacatgcggaggctggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctgtggtttgcagaggggcagcggtacagccacgcggcaggagagtgtgctcgcaacgccacctgcacccactacacgcagctcgtgtgggccacctcaagccagctgggctgtgggcggcacctgtgctctgcaggccagacagcgatagaagcctttgtctgtgcctactcccccggaggcaactgggaggtcaacgggaagacaatcatcccctataagaagggtgcctggtgttcgctctgcacagccagtgtctcaggctgcttcaaagcctgggaccatgcaggggggctctgtgaggtccccaggaatccttgtcgcatgagctgccagaaccatggacgtctcaacatcagcacctgccactgccactgtccccctggctacacgggcagatactgccaagtgaggtgcagcctgcagtgtgtgcacggccggttccgggaggaggagtgctcgtgcgtctgtgacatcggctacgggggagcccagtgtgccaccaaggtgcattttcccttccacacctgtgacctgaggatcgacggagactgcttcatggtgtcttcagaggcagacacctattacagagccaggatgaaatgtcagatcaagagccagaaagtgcaggacatcctcgccttctatctgggccgcctggagaccaccaacgaggtgattgacagtgacttcgagaccaggaacttctggatcggtgagtgcccagctgattgggggaaccctgggccatggcggctgccagcagatggcaagggtgtgttgagggcctggagcccagagcggggccagctgctcaccccctttcccggggagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtttggcaactgcgtggagctgcaggcttcagctgccttcaactggaacgaccagcgctgcaaaacccgaaaccgttacatctgccagtttgcccaggagcacatctcccggtggggcccagggtcctgaggcctgaccacatggctccctcgcctgccctgggagcaccggctctgcttacctgtctgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcgaaggagaggacaccgccagtggtccaaaaaggctgctctcttccacctggcccagaccctgtggggcagcggagcttccctgtggcatgaaccccacggggtattaaattatgaatcagctgaacctg

SEQ ID NO: 461376 - DNA, 613 bp, Homo sapiens
gtgcatgtgtgtccaggggaagatctgcagaattggagggagcacggagtgtgcacacgtgttctcggggagcagagagtgtgtttgtgtgtccaggggaagatctgcagaattggagggagacggagttgtgcatgtgtgttcctggggaacagagagtgtgcacgtgtgtccaggggaagatctgcagaattggagagagacggagtgtgcacgtgtgccccgggggagcatggagtgggcacgcatgtcccaggggaacatctgtccaaggcaaagaggaaggagcaaaccccagcaactgtgtcactttccataacggaggctctgatgctcgtctccgggaagaaaagctccctcagtggagccttctcccaacattaaacattggaaacagaggggagggccaggccctgcacctgcaccccggtgtgtccacgcaccgtgtagtcttgagggagtggctcagcctctctgggcctcacaatataacctctctcaagatgattccccctctcagtaagtgagggttattattattagctcttagcaaaaatgaaacaaagaaagaacaatgggacttttatgctgggaaaaggacactgaagaaaca

SEQ ID NO: 461377 - DNA, 2484 bp, Homo sapiens
gttttgttacttaaaaaattcagcttcaaagaatattgtatagaaattgtgaggccaatccacgcagccctctatgctatacaagttggcggcagagccaatggttgtgccgagactcgccgctgcccgggctgctgggtcttgagtgtcacctacactgccatggatgccaccggacgctgacagacctgtggagagtcgggttgtgcctcccgggccttatcgggccaccaagctgtggaatgaagttaccacatcttttcgagcaggaatgcctctaagaaaacacagacaacactttaaaaaatatggcaattgtttcacagcaggagaagcaggggattggctttatgacctattaagaaataatagcaattttggtcctgaagttacaaggcaacaactgttgaggaaatttcttaagaatcgtataattgaagatatcaaagggaggtggggatcagaaaatgttgatgataacaaccagctcttcagatttcctgcaacgttgccacttaaaactctaccacgaaggcatccagaattgagaaaaaacagcatagagaacttttccaaagataaagatagtatttttaaattacaaaacttatctcgtagaactgctgaaaagcatggattacatttatctcaggaaaatgccgagaaaataaaacatgaaataataaatgaagatcaagaaaatgcagttgatgatagagaactaagccaggaagacgttgaagaagtttggagatattttattctgatctacctgcaaactattttagaagtggaccttgatgagcttcttgctggaagattagtttctttcttaatggatcatgatcaggaaattcttcaagtaccctcttacttgcagactgcagtggaaaaacatcttgactacttaaaaaggggacatattgaaagtcctggagatggactatttgctcctttgccaacttactcatacgaagatgaggatgtaaaagaagtataaggcaatcatatattcattcaaaagatatttatttagcaactgctatgtgcctttcattattccagatatgcggagacaatgataaataaaacatataatctcttccataagatgtacattgtgcaaatattttctcccattctgtaggttgcctttccatattcttgatagtgttctttgagaaaaaactataaatatttgtaattttgatgaagttcaatttatctgttcttttgttgattgtacttttgttattgtacctacaaaattattgcctaactcaagattacaaagatttactgctatgttttcttctaagtgttgttatgctattgtctcttaggtttaggaggctcatgatcaatcttgtcttaatttttgtgtacagtgtgaagtaaggatagaactttattcattcacttgtggatactaagttgcccgaccattatttgttaaaaaaacaaaaaaacaaaaaaacccaaaaaaacctgttctttccccacaaaattatcttgctgctcttgtaaagaatcaaccagacataaatgcaagggtttatgccaataccatactatcttaattattgtggatttatcataaattttaaagtcagaaaatgtgagtcctcctttgtttttcgagattatcctggctattctcaatcccttgaatttccatatgaattttagggtcagcttgtcaatttctgaaaaaaaagccagctggaattttgaaagggattgggttgaatctgtacattaatctaaggagtattgccatcttagcaacattgcattttctggcccatgaatatgggatatcttttaacagcaacactgggaactggaagacaacggaagataacttcaatgtgttcaatacaaaaccctgcaaaactaaaattctaattccagtgaaagtatctttataaaatgaagggagaagaagtgagcatttggtgacagagagtatagataaatcttcaaagattgttgctataaaggacagcataaaaaggattggtagctggagggagatatgaagttgatttttaagatgagcaacttaaaaacatctcatatagagaagaaggaagtgatgaaacagtggaaatcagggctaattggaaggatgatgtcccttagtaacttttagcaggtgaggagggtagcatccaaagggaggtaaggtgagagaaggatgaaggatgagggtacagaagctgaagaataatgatagggaagatcaagagttctccattagaccactgtgtggagtaggtagcaaagttataagggagactgaagggaaagagtttgttggaaatttgagaaaaacagaaaagtatgaaattgtcatcttggggaataacaaagtgaaatttccatgaaaataaaacaatttagcagttttcagtgcctatatgatataaatttgaagacagcctagtcatcagagttctaagatttttttccagtgatgtt

SEQ ID NO: 461378 - DNA, 2685 bp, Homo sapiens
tacggtacgttaatcagactcacgaacagcagctggtcatttcgatatttccagcagtgagccaggcacctggtcactttgcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtccccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatggctctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgt

SEQ ID NO: 461379 - DNA, 2873 bp, Homo sapiens
agagtcttatccccggctctgggtagggctggaggtttctcaggtattagtagtagtggttataacacatactactgacaaactacgagatagggccgcgtcaccagtctccacgagataattacaaaaacacgctgaatatgctgaatgaacatactagagagccgagaacacggccgtatgattactgtgacgagaatagggtacggtgacctcagtgagtctgactactgcgtgcagggagccctgctcgaccgtgtcctcagttgcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtccccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatggctctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgt

SEQ ID NO: 461380 - DNA, 2655 bp, Homo sapiens
tgaggatcccggataggggagtcgtgctggtgctaagggatacgtgctggtgcttaaacgaactgtggctgtccatttgcaaaaaaagtgagttcttggcattcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtccccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatggctctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgt

SEQ ID NO: 461381 - DNA, 2926 bp, Homo sapiens
gatggccagagctgaggccaagctagaggccctggactgtgctgactcccggcagacacagagcgctgacctggctgccgagccccgcctcctaggctgcaggggtgcctgcagaagggcaccacagggccaccggtcctgcaagctttctggggcaggccgggcctgaccttggctttggggcagggggtgggctaaggtgacgcaggtggcgccagccaggcgcacacccaatgcccgtgagcccagacactggacgctgaacctcgcggacagttaagaacccaggggcctctgcgccctgggcccagctctgtcccacaccgcggtcacatggcaccacctctcttgcagcctccaccaagggcccatcgcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtccccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctagggccaccctctgcggggtgtccagggccgcccagaccccacacaccagccatgggccatgctcagccaccacccaggccacacctgcccccgacctcaccgccctcaaccccatggctctctggcctcgcagttgccctctgaccctgacacacctgacacgccccccttccagaccctgtgcatagcaggtctaccccagacctccgctgcttggtgcatgcagggcactgggggccaggtgtcccctcagcaggacgtccttgccctccggaccacaaggtgctcacacaaaaggaggcagtgaccggtatcccaggcccccacccaggcaggagctggccctggagccaaccccgtccacgccagcctcctgaacacaggcgtggtttccagatggtgagtgggagcatcagccgccaaggtagggaagccacagcaccatcaggccctgttggggaggcttccgagagctgcgaaggctcactcagacggccttcctcccagcccgcagccagccagcctccattccgggcactcccgtgaactcctgacatgaggaatgaggttgttctgatttcaagcaaagaacgctgctctctggctcctgggaacagtctcggtgccagcaccaccccttggctgcctgcccacactgctggattctcgggtggaactggacccgcagggacagccagccccagagtccgcactggggagagaaggggccaggcccaggacactgccacctcccacccactccagtccaccgagatcactcagagaagagcctgggccatgtggccgctgcaggagccccacagtgcaagggtgaggatagcccaaggaagggctgggcatctgcccagacaggcctcccagagaaggctggtgaccaggtcccaggcgggcaagactcagccttggtggggcctgaggacagaggaggcccaggagcatcggggagagaggtggagggacaccgggagagccaggagcgtggacacagccagaactcatcacagaggctggcgtccagccccgggtcacgtgcagcaggaacaagcagccactctgggggcaccaggtggagaggcaagacgacaaagagggtgcccgtgttcttgcgaaagcagggctgctggccacgagtgctggacagaggcccccacgctctgctgcccccatcacgccgttccgtgactgtcacgcagaatctgcagacaggaagggagactcgagcgggagtgcggccagcgcctgcctcggccgtcagggaggactcctgggctcactcgaaggaggtgccaccatttcagctttggtagcttttcttcttcttttaaattttctaaagctcattaattgtctttgatgtttcttttgtgatgacaataaaatatcctttttaagtcttgtacttcgtgatgggagccgccttcctgtgt

SEQ ID NO: 461382 - DNA, 1390 bp, Homo sapiens
ttgggtttggtggccttgtcacttccaaggggctgagcacagcacatgtaccagccatcttggaagccacctcatgtgccagaccagatgggccacacccctgtctccactgagagtgagcttgctgtctccagaggaaaagagaaccttggcccacaatttctgcagcaagcagcacatgaagccaaaccaaacctctgtggcaatgggcccagaatggtcagggctctgtcaatcctggtcagcttccctattgttgactactgcttccaactcaacacccatgaaagaaagccaaatatgctcctaatgcaatcacataagatctctaggggaagccagctgccatgttgtggggatgctcaaggagccctgaggagaggcccatgtgatgaggagctgagaggacttgggccaaaagccagtggagaattgaggtctcctgtcagtagccatataagcaagtattctggaagcacatcctccattcccagtcaatatcttaacttcaacctcatgaaagaccttgagcctagctcagccactcccagactcctgacccacagatactgtgtgagacaccttgaatcacagatagttggagatgaaaaggaccttagaaaccatgagaaacaccatgggcgaggagactggggagctctggagccataaacctggcttcaggtcccagttctgccactcaccaactgagtggccaaggacggcatttttcagagaacaggagggagctgcttccttaagtatcgcctgggatcacattcagactggagatgttgccagaagcaaatccacctcggtggggattctggttgacccaggagaccctctgctcctgagggaactgctgaggggcttgggctatgactccaggaccaagagttttgggagagactttccttccctggacaaggaaaaggaagtggagctaccagctgctgctctgggaggctagaggctcatctctctaccatgcaccctttccgaagctctgttctctgagggcttctggaaatacccgctttaatcagagttaagccggatttgaaggttgcgatgattagatgtgtcaaaaaaattttacatctaataacacccaacgctgtcaagaatgtggaaaaaaacagacatgtatgcattgttgatgcgagtgtcaattggtacccattttttggagggagtttgctagtatcattagaatgtgaaatagatatgctttcagactcaacatttccacttctaagagtcaattctagagaaatatgtgcacatggacacaaagagtcgggcatgaagatgtttgcagaaatgttgtttgcaactgcaaaaaacagtaaaataaaaagccaccaaatcaaaaaaccaaacacct

SEQ ID NO: 461383 - DNA, 1755 bp, Homo sapiens
tggagcctgcagctgagaggggccccggcttagcccctgtggggggacccccacctccaccaatcccgcccactggcttggctgtgatgagaacgatcattccttcctctgactcatcaaccttttgtgctcctatggccagcatccaccttacacagcagcagagactcaggttctcatgccctcagctggggatccctgagcatccgggtcttctgaaatggactgctgcaaatgctaagttctgcagcaactggggagaagagtgttggagggagttgcacagaaaggaccatccactgaatgttccagaaggcagcagagtacagtagttaagagcacaagatcttcaacctgattgcccgggttcaaatacagcttcacctcttactagctaagtgacttggggcagattacttaacttctctggacctcagctgcctcacttgaaaaagggaggtagagtgcctacttcagggtgttgttctgaggacagagtggccacatataagtgccctgaggacaggctggtgcacggtcagtgctaagcaagtgtgtgctgccattattatcagcgaagccccaagaagggaattcccagtcctgggggagggctgacaggggctggcataggcacagcccccagactatagccactttccgggtccgtttcccatgtgcttttggaagatacgcagggcagacaatcagccccattctgcagatgaggaactgagcttccttcagatcaagtgccagtgagggaatggtaaagacgccagagctcctcagccctggaccatggctcctttctcttcaccagaccgtcactgtgcacctgttgagcaggctcccacggcagccaccccttcccagccccccatgccggagggcctacgcgcagcccccatgcaacgcgctcatcacagacacgcaaacccatccatcgccctcttcaccactggaccacacctcagcagggccacagaaatgggacccagacgtgacgccttctgactcaaaggcccacaaccgccccctccaaaagggcacatacactgcatcctggcaccctccgcaacacatacagcatgccagctctgcagaaaacagcgatcgcgtcccacggccgcccctcgctcggacgccataccagggcccccttagtcgccccccagcgtcgtgcgcgcccgggggcggggccaggctcagcccccgacccctgcgcccccaggtcaaccccaaaggagagcggtctgggcgcggggcgcggtcggggctcccgcagcgccgggcagcggagagggggcctggcagttggctccggtccgccctggccctgcccatccgcctgcccccccagcgcctgccccggcccggccccgtgccgccgccgccgccgccgctgacatcatcggctccccccgccccggtcctacccccacccccacccccggaaacagtccccccccagcgccgccgccgccgccgccgagaggaggccggcgcagcgcagccgacaccgacacaaagctccgagcgcccgacggccttccccaggactgatccccgcggcatgacactgcgccgcgctgggccaccgggcgggctctcagggtgcagacatgacatggcagactcataatcaggcccggtgggactcacagacccagggaatgcgcaggaaagctcagcaggccgcggaaaaagaaggccctggccctgcatacggggcacacacgaacgaccaccagc

SEQ ID NO: 461384 - DNA, 691 bp, Homo sapiens
ttcaaacacacagtactcagcgtgagccaggcgtgatggcagatacccatagtcccagctactcaggaggctgcagctagaggattgcttgagcccaggagtttgagtccagcctgggcaatatattgagacccagtttctaaacaaatgaacaaaaccccagacacccagtgtgctctccagcttctacatgacccacaccttcatgcctttgcctgtgctggcttgttctgccagaaatgctctttccccaagcttgtcaaaatccctccaaaacgttaagatctgactccaaggccacctccttcttggccctccctgatccacaggatgagaacgatcattccttcctctgactcatcaaccttttgtgctcctatggccagcatccaccttacacagcagcagagactcaggttctcatgccctcagctggggatccctgagcatccgggtcttctgaaatggactgctgcaaatgctaagttctgcagcaactggggagaagagtgttggagggagttgcacagaaaggaccatccactgaatgttccagaaggcagcagagtacagtagttaagagcacaagatcttcaacctgattgcccgggttcaaatacagcttcacctcttactagctaagtgacttggggccagctggagggggatcctctaagcgccgcagaacctt

SEQ ID NO: 461385 - DNA, 1999 bp, Homo sapiens
ttcaaacacacagtactcagcgtgagccaggcgtgatggcagatacccatagtcccagctactcaggaggctgcagctagaggattgcttgagcccaggagtttgagtccagcctgggcaatatattgagacccagtttctaaacaaatgaacaaaaccccagacacccagtgtgctctccagcttctacatgacccacaccttcatgcctttgcctgtgctggcttgttctgccagaaatgctctttccccaagcttgtcaaaatccctccaaaacgttaagatctgactccaaggccacctccttcttggccctccctgatccacaggatgagaacgatcattccttcctctgactcatcaaccttttgtgctcctatggccagcatccaccttacacagcagcagagactcaggttctcatgccctcagctggggatccctgagcatccgggtcttctgaaatggactgctgcaaatgctaagttctgcagcaactggggagaagagtgttggagggagttgcacagaaaggaccatccactgaatgttccagaaggcagcagagtacagtagttaagagcacaagatcttcaacctgattgcccgggttcaaatacagcttcacctcttactagctaagtgacttggggcagattacttaacttctctggacctcagctgcctcacttgaaaaagggaggtagagtgcctacttcagggtgttgttctgaggacagagtggccacatataagtgccctgaggacaggctggtgcacggtcagtgctaagcaagtgtgtgctgccattattatcagcgaagccccaagaagggaattcccagtcctgggggagggctgacaggggctggcataggcacagcccccagactatagccactttccgggtccgtttcccatgtgcttttggaagatacgcagggcagacaatcagccccattctgcagatgaggaactgagcttccttcagatcaagtgccagtgagggaatggtaaagacgccagagctcctcagccctggaccatggctcctttctcttcaccagaccgtcactgtgcacctgttgagcaggctcccacggcagccaccccttcccagccccccatgccggagggcctacgcgcagcccccatgcaacgcgctcatcacagacacgcaaacccatccatcgccctcttcaccactggaccacacctcagcagggccacagaaatgggacccagacgtgacgccttctgactcaaaggcccacaaccgccccctccaaaagggcacatacactgcatcctggcaccctccgcaacacatacagcatgccagctctgcagaaaacagcgatcgcgtcccacggccgcccctcgctcggacgccataccagggcccccttagtcgccccccagcgtcgtgcgcgcccgggggcggggccaggctcagcccccgacccctgcgcccccaggtcaaccccaaaggagagcggtctgggcgcggggcgcggtcggggctcccgcagcgccgggcagcggagagggggcctggcagttggctccggtccgccctggccctgcccatccgcctgcccccccagcgcctgccccggcccggccccgtgccgccgccgccgccgccgctgacatcatcggctccccccgccccggtcctacccccacccccacccccggaaacagtccccccccagcgccgccgccgccgccgccgagaggaggccggcgcagcgcagccgacaccgacacaaagctccgagcgcccgacggccttccccaggactgatccccgcggcatgacactgcgccgcgctgggccaccgggcgggctctcagggtgcagacatgacatggcagactcataatcaggcccggtgggactcacagacccagggaatgcgcaggaaagctcagcaggccgcggaaaaagaaggccctggccctgcatacggggcacacacgaacgaccaccagc

SEQ ID NO: 461386 - DNA, 872 bp, Homo sapiens
ataaaactacttagaatcccaagatggcaactgtagagcatttaaacccaagcatgactctcttctgcacatctgcacatgaagttctgtgcaactgcactagccacaaacccaaaattgccttgcctcttcactttcaatacttactgtctacccttgagaaaaaaaaaaaatactccctgagcctctatctatatgaactccctctcaattttgttgtggggttaaatcaaataattttcaggattttaacttgctatacctgttgtgaattatcatccattattattctggtggatcttagagggatgattggagaggtagatctggaggaagatagtccatttgacagcgtaaggaccataactcagacgcaagatcactcagatattcaaggtaggggctaaagggaagtgggctcaatataaaatcttgaataataccaacatttaaagtctggctgatgaagactatcagaagaaagaaatcaggaaatggtggcaagagttttcttttctacccccttgaaaagacatggttaaaagactgatgtctgttaaaaaatggattaaaacttggagatgaataaatacagtgcctcagctatatggagcttatgctatgagctggtatgtgagcttggattcaagcctaagtcactgactccatgattcatgctcattactgatgctggagagaaaaaagaaatggattctgcagctcattgctcattgtcttaaagagggagtggtattccttgtttttgtttttaatgaaatggttttttaaaataaaatataattttctcattttcataagcctaagcctatagtctaagttcttactcatgatttagaatgattgttattgac

SEQ ID NO: 461387 - DNA, 1977 bp, Homo sapiens
accgggcgaggccgagtccatgcggtccgggctgggcgccgcgcttgggggcagcgggcctgggccccagacgaggcgtggacctgctggcccggcccgcctgcccctgggctcctcggctgctgcgggcctgggccacccgtgtcagcgcggccctgctgacagcgcagttcacacccggggcggccgcggcaggtgcagtgcgaggggcgccacctgtaggctggtgtgggcactgcctagaggttgctgtggcgccgtctggaggttgccgtggctctcgttggcgcccagcgccgcgcccggggcttcatggctgtgtcgctgctgccccctcccagggccgcagggcccgggttccacttggcggcgtcttctcgcgagtcgctttcgctgctccaagaagtcggcggtgcagcaactgacgccgctgctgctccggtcgccgcaggtcgccatattcctcgcgggggccggccgggctctcggctcaggccgcccaccctgctccggccgccgccgcctctccgttcccgcagccagaggaggcgagggagcgacctccaggcactgggcgcccgccgcttccccagcagccggcggggcggggaagaaagacgccaggaagcggaaggcccccgccggcccgagggtcgcccggggctgtgccccatggttcctggcccgcgagcagctgctgggacccccccttgccaagttgctccccgaaaagctctaaggttctcaggcctgcagggagtgacagtttccccctgactgtaacgtaaggctgcaaactcgaagccaggaattttctgcatattcttaaatagaatgtttcagtcaaagccttgataatataaccaatctttctgattgtagcctgcttataaagagaacatatgtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttggcactcatgatgagcccctgttctcattctgcaaatggtgaagctctctattgtcctgaccccacagttcctgtcgcatgaccagagccagttcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaatagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttgtctgggggctgaacctccttctgaacaatgatccaagataaaagtactaataccacaatgcttttttatattcaagggaagaggaagtatgtttcagttttaccacctagataattacacgtcatttggcactgcctttcaagatatgt

SEQ ID NO: 461388 - DNA, 1009 bp, Homo sapiens
aaaattcgggaaaaggtttccccctgcctggaaagtatgatctcgtgaaaccttgagagaaactgaatgacgaatgaaactattgttcctgtttcacacagaagaaaactgaggttggcactcatgatgagcccctgttctcattctgcaaatggtgaagctctctattgtcctgaccccacagttcctgtcgcatgaccagagccagttcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaatagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttgtctgggggctgaacctccttctgaacaatgatccaagataaaagtactaataccacaatgcttttttatattcaagggaagaggaagtatgtttcagttttaccacctagataattacacgtcatttggcactgcctttcaagatatgt

SEQ ID NO: 461389 - DNA, 963 bp, Homo sapiens
ccgcgtgtcctgttgcttccctgatcttctccgtgacctgtagctaaaccttccaccagcgcttgagaacttaatttgaaccggaatcctttcccagacccctttcttcttctcctcctcctcctccacctcctccagggcaccctgaaaggatcatgacatgcgctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaatagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttgtctgggggctgaacctccttctgaacaatgatccaagataaaagtactaataccacaatgcttttttatattcaagggaagaggaagtatgtttcagttttaccacctagataattacacgtcatttggcactgcctttcaagatatgt

SEQ ID NO: 461390 - DNA, 1113 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcagctcccagccgaggacgtcggatgtcatcgtccttgctgctttgccaccccattcccgtcaataaagtggtttgaacccaaaaaaaaaaaaagaacacagaaacctatacacaaaactcgtttggtgggacgctgggcatggagcactatcggaatatagatcttctctgtagaacaccctattggctttgtggtgcgcacggggggtccgcactttctctgtctcacctgggagaacttatgtgtgcgacccgaattcgcggtttggttcaccactaggtgggagagaaggctccccctgggggcgtcactgagggcatttacggcggcgctgggggcggttatcttctccgcccctttctctttaggacataacatccgcccgcccgagtgggggagacggtaaattccccgcggcgattgcggtcttttcgtcgggagaccccccagttctactccttccagttacgcggagtgagtcttcccacaaggaggggcggcgcccccatttttcgcgggggaggggaatatgcttttttgtttctaccacccttggggaagaggtttgtctcggcttaacccgcagtggagacgccggccattagcccctttctggcctttttttcccagcgcgcccg

SEQ ID NO: 461391 - DNA, 120 bp, Homo sapiens
aaaaaaaaaaaaatcccggccgcgtcgaccgggaggtcagctcccagccgaggacgtcggatgtcatcgtccttgctgctttgccaccccattcccgtcaataaagtggtttgaacccaa

SEQ ID NO: 461392 - DNA, 1298 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaacctgactgtccggctgctaggctgggcaattttccagctgttttgccacgacaggcctcaatccgtaataccaaggctggaatggcgtgttaggggggcggtggctgacggggatacgcggactcttgatgcgtaaggagtgcccctctgctcccatacgttccccagcccagccttccctgagtgtatcgcgcgcgctgtgccttcgccgtgagttcgacataagtcccaggctgtcgcgtctgccatcagacgcgcagatttagttgaaggcagcgtggaatggcgtctgcagggctgttgtgtacttgacataaacagattcggtgtggaactgaagagttaa

SEQ ID NO: 461393 - DNA, 747 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagtgatctatcactctcgttcttgtagctcccagccgaggacgtcggatgtcatcgtccttgctgctttgccaccccattcccgtcaataaagtggtttgaacccaa

SEQ ID NO: 461394 - DNA, 556 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcagctcccagccgaggacgtcggatgtcatcgtccttgctgctttgccaccccattcccgtcaataaagtggtttgaacccaa

SEQ ID NO: 461395 - DNA, 785 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaa

SEQ ID NO: 461396 - DNA, 1767 bp, Homo sapiens
aaagtcaggatgtggtgcagatcggtccattttcaatacaagctctttctaccacgacaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaacaagaaaagaagagagagagagggcgcgacggggggcaaagatatgaaagaggaggggacacgtgcccagcccacgtacagcgggagaaagggaagcacatggaagagaggggaaggagaagcgtagatgaggagaagaggacgcgacgaagagagagcagacaagagatcacacgagaaggaagggcgaagagtggagcaggtagaggaacggagaacaacaacacaggcacagaggcaatcaaaaagggcatcagaagaagggtgacgatagagtagagaggacacgcagaaaaaaagaaaaacaccactcgagactaggctatctagacaacgtaaagacgaagcggaggtgcgagaaatcagaaagcaattacaaactgagaggcaagagaagagagacgatgacaccacaacacaagggaagagaaaaaaggaacagagaagagagcgggggtgcggagggaggggaggaggatgctggaaagagtggaggagggggtggaggagccgcgcagtgtgagctgtagcgccgaagcaaagcgaatggcgtgatacaccatccggctgcagggaagtacagggcgtggagtggagccaccgcatcatcgacccgtacgacagcgggcgcaaaacccgacacgtaacacacgacaggccacagctgtccacccgccaagaagacac

SEQ ID NO: 461397 - DNA, 960 bp, Homo sapiens
  misc_feature (831)..(831): n is a, c, g, or t
tacacgacaccacggacgtgccacgtacccgccatcgggaccaaggaccactgagaaaccatgaaggccatgcagcgactgtggtggcaggaccgtcaggaggccataggtgccacggctcccctctggtggttcacctgcccacctgtagctggggtggcccctccagtgcgctccccagagcagaacaccccccaggcaacacgtctgatgaaggccaacagcgtcagtcctctggtgtttggtgacatcaaagctgtgccgaaaggccttccctcactgctaacacttgaagggcttctgtccggtgtggaccctctgatggcgaatgtggtctgtcttatgcttaaagatccacctccattaactgcactcttagggtttcttcctctgaaaaggaatgaacacgggaaccccctcaaaggcatttttaaatgaagcgtggaaggcatcaaagatgtgctcttcttcaggactcaggcttctccatcattctctgttccttggaagcgtgagggctaaggagctgctgacttctctctcttggccccacttcaagaaaggcttgcttcccacacacctctccacgctcccagtgcgggactgacactctgcaccgggaggccaagggccaccatcgtcttgctgggagcaaggtgtgacgtttcttggtcataggagggagtgtgatcctgacaccagaggacttaataataacattgccagtgttaacatcttcaactggcagattcatggactttcccccttccttgaatgcatttcaacaccttgacattgaacgatgcctcatgtctctgcagggtgggacangagctctaactctctgaagctgagtttggacaggttgaaccattccacagtctatcttgaccttgaatcaagtctccgagtgacagtgtttacgatcatattgccaagtcctgggtgaaatgagagagc

SEQ ID NO: 461398 - DNA, 1117 bp, Homo sapiens
tgggacggtgaagattttgggggatggtatggacagataatcggcgatgtttctcagggctgcttccggcaggattaggggcagcatgggaacctagagtgggagagattaagctgaaggaagattctgtgtttgtgattttgagggcctctaaaagtattagggcagcagcagctgctgcacggagacatgatggccagcctaaaacagtaaggtcaagttgtttggacaaaaaggctacaggatgccatcctggtccttgtgtaagaattccaactgcacagccctgcacttcggctgtgtgtaatgaaaagggttgggatgagtcagggagagctagagtgggggcagtctctaaagctgtcttcaaggaatggaaagaggagtggggaaaggatttaggatctatagggtcagctaggtttccttttgtgagtttatataatggttttgttaggaatgcaaaaccaggtatccaaaggcgaaagtatccaaccatgcccaggaaggaaaggagttgttgttttgtagaaggggttggggtttgagagattagttgaacacgatcggcagggagagaacgtgtgtttttatgaagaattatgccgagaagattcaaaggagggactacaaagaagaaggtcatgaatatattgaataaggtgagaagcggaggggtggaaagaaagtaaatcatgagaaagagcttggctgaagtaaagaggactgtccctgaaaccttgcggcagcacagcccagaagtgaggaaactgcatccagtcagtgcaggtcattaaactcaagcaaaagttcactgaagcaaagacacctattgtttatctcacaaaataactggagggttttccagagagagtggagcacaaggtaaagggctgttcttagcaaccagagctaaagagctgtgtgggcttacccatgaagagtactgaaaattcaagttgtgttattagaagtgaagttatatcctgtgccatccatgtcccttcctacttccccatgacagacgtaagggtaagacttctggctaagggaaaggtgtacagactgtgctcctaaaataaaattaaattaaacactgcctatgagaaatgatttc

SEQ ID NO: 461399 - DNA, 998 bp, Homo sapiens
tcttaagaagagccctccaaaatgcaaaacaggtatgcgatgtgtcgatctggtttaagcagggatttgcagactcctggatctaccagcttcacctctttcttaccccctgcaacaggccccgagacatcacagatcacatccagtcagcagattcattcatttactcacttgcctttttatgaattcattagaccggtggttattgagcactcagtatgttccaggcactgtgctaggtataagggatggtatacggcacaggagagggattcagtcctcgacttcatgggtattacattctggtggaggactcctgcatggaacaaggagtcacagctgaggctctatccagcaaagatattgaaatcagccattaaaaaagtacacaatgacagggcccagttcctggattcaggggttgggcacttggggcaggcagtgaagtcccaggcaggaaactgagggagactttcatctgagctgcagcaacttggaatattggggcagtctgcactattttcacacacaacacttcttgctctaaatgtacttagagatccaggagatgaactcaagagcagcccgttgcctgcagtggctgacatgaagcctttctgcgtcatcggtgtcttgtctgatgcttccccagtggaatttcctgctgtgttcctgggaaacccaagcaaccagaagttcatccaattatttatttgcttcgagtcatccggatgtaaaagtatgcagctatcatatactggtgaagactccttccatgtaaacatccacatactctggggaaacctgctgccaaagtaggaggattccaaaggacctagaggaagaaaaagctacaatatggaagacacctgagtttctgaaggactgtgtggagcacttccttctgctgatgaacatgtgctatgaaaaataaacttattttgtttagcaactaagatttctgaattacttgttacagcagttagtatatcctgatt

SEQ ID NO: 461400 - DNA, 2390 bp, Homo sapiens
ctgaggcacactggactgggccccccaaccccagccctcctccctagcccgccaggcctttgtttccccacctgtaaaatggggcagtgtagccctcacatgaaatggtacttctaaggcacctgtgagccggagccctgctctgatggctgtgggagagaggggatgatttttctaacctccctccacccttcccagtgctatgggaggcagacaccaagttctggggtctccagttgcagcgggtggctgctgattgcttctctctgtccagaacgagaacaagagcgcactgcagttggagcagcaagtaaaggagctgcaggagaagctgggctagctgaaggggacggtaacctccgacccgtccaagaaggtctgggaggcgggcaccagcctctggggaggggaggtgccaggccagaggcagctgcagcctgggggcaggtgaccccagcaccctccagggcagtcctatgactgtttcttgcttcctgccctctgacttttagaggcctggagcaaggggccaggggcctgggcaggccacagagccccacagtgccctcactaccctattaatgggccaggaatctggaagccagccaccagctgccctcatgcccagggacttccagcaggtggagctgaagagccaagaggctcagagtctgcagcagcagcgaggccagtacctgggtcacctgaagcaacccggctcattggaccagctgcagcagcaggaagctcagggcaaagcagtggctaagatggcccgccaaaagttgcaggagacccaggggagggagttgctgaggacggggccccaagagggacaacctggcaacctctgtgccttctcaccctctttcctggcatctcaggagcacctggaagctaccagccagcagaaccagcaactacaggcccagttgagcctcatggctctccctggggaaggggacctggagagccgggagacggtggtggcatttttcaactccgctggaaccagtgcccaggaggagcaaaggatgtgctgccagcccctggctcacccagtggcctcgtcccagaagaagccagaagcagcagccccagccccagggactgggggaaagtacatcaccccatatgggagccaggggacagtgccaaagatgcggcaccgggaggaggaggagatcgtcaggctggcccaggaccgggaggagatgaaggtgaacctgctggagatgcaggggcaggtgttgcggcttgtgagagaccacaatgagggacatggcaagttcctggccactgcccagaaccctgctgatgagcccactctaggagccccagccccccaagagcttgtgtgtgctgacaagcaggatggccagtagaaccttcaggcagggtgagcaggcaggagcaggggaggctcgcatggcgctccgatcccctcctccctctctccgaagatctttgtgaggtgagcctcactgacagcgtggagcccgcaccaggagaggccagggagggttctccccacgacaaccccactgcacagcagatcatgcagctgcttcctgtaacgcaggactccccaggagcacccaggcttgggcagcaatctctgcatgcctttcttttcgagctgccgagaacagggagataaacaccaccatcatctaagagctggtcaagaaattaaaaaaaaaaaaaagttaaggggttaatctcctacacaattcatttacttcatttgaatgttagagccactcatgtttatttgtgtttctaatttatagtttaaattttatttgtaaaaagttaaaggagagtgggtcttttcctcatgttcactctggcatcctttagcatgtttcttttttaatttgataattgtaggaaaagtgtctgtacaatcacagagtcctacttcctccgaaagttctttacgaagagtgaaatatgtttttgtacctttcagtttcagttagaggcatattttgtgcaatatttatgtgaatgcgcctatatattatgaatgaattatttcagtcatatgttgcctaaatcataacttgatgatgcttgggaaagaatcaacagttaaaacctcatgaagttctaatgtctgtattccaaaatacatcacattattaggatgtagggagagatgtatgtgcgctccctggtgtggggatttgtagttactagaccgtctccatttggcatcctcatgatacttttataaatatgacattaataggaaagcagtattatttttcagacaaaataactgatttgcctggattcacggaaaaaaatgcaaatattgggtccttgtgacttcaactgactcttccaaattgtatgaatttattaatgtattagatagaatt

SEQ ID NO: 461401 - DNA, 3535 bp, Homo sapiens
aagatatttaaagatatttttaccttttccattttatctaatggtaggggctgaaataaggaggtaatgtaaaataggaatgcataagggatgatttccccctgacatttgctaactgaaaactggaattcatagacttactagttcagttagattattttttaaaaacactgtaccagactccctcccaattttttgtttattgggaaaaagtaaaactagtttggagtctaaaaaatagacatatggccacagaccatacagcatgagttactgaggtaaaatgttcatttcccccaggtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgtccttttcttgcacgtgttcatataacaagatgatgattatcttatgattggattttaaaagattggttatttcctctgtattttggaggaatttttgtatttggatgaaatggcagcagatttattcattaatttat

SEQ ID NO: 461402 - DNA, 3774 bp, Homo sapiens
cccacccaatgagaatctctggtagagaggctcgaagtcgtctttttaataagctccaggttattctgagaatcaccagtatttgaggaccctgcctgcagcttatttataatgatgctttttccatttaggcagtagtgtcagtgtattaaatgagtacctgtgaaatgaaaattaaaagttatatttattctttcatgtcagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgtccttttcttgcacgtgttcatataacaagatgatgattatcttatgattggattttaaaagattggttatttcctctgtattttggaggaatttttgtatttggatgaaatggcagcagatttattcattaatttat

SEQ ID NO: 461403 - DNA, 4642 bp, Homo sapiens
tgttgcatccaggtttgctgagctgaagtctggtgatgccgccattgttgatatagttcctggcaagcccatgtgtgctgagagcttctcagaccatcctcttctgagttgttttgctgttggtgatgtgagacagacagttgctgtgggtgtcatcaaagcagtggacaagaaggctgctggagctggcaaggtcaccaggaaactgaggcgagacgtttatggcgcagagagggatgtggctgctgcagctggcttggagacctgtcaggtgtttccaaactatcatatttatcctccaactgcacctcacgttgcttatatgcaaccgaaagcaaacgcaccttccttcttcatggctgatgaactccgacaggagctgatcaacagacatttaataacaatggctcaaattgatcaagcagatatgccagcagttcctacagaggttgacagctaccatagcctattccctctagaaccactgccacctcccaaccggatacagaaatcaagtaattttggatatattacatcttgctacaaagctgtaaacagcaaagatgatctgccatattgccttcggaggatacatggttttcgtcttgttaacacaaagtgcatggtgttggtcgacatgtggaagaaaattcaacactcaaatatcgtaactttgcgtgaagtatttaccactaaagcatttgctgagccctctcttgtgtttgcatatgatttccatgctggaggagaaactatgatgagcagacactttaatgaccctaatgctgatgcctacttcaccaagagaaagtggggtcagcacgagggaccattgcccaggcagcatgctggattattgccagaatctcttatttgggcatatattgtccaactaagttctgcattgcgtaccattcatacagcaggtttggcatgtcgagttatggatccaacaaagattctgataactggcaaaacaaggttgcgagtaaattgtgttggagtttttgatgttttaacatttgataacagtcaaaataataatccattggcattaatggcccagtaccagcaagcagatctgatatcattaggaaaagttgtgttggctttggcttgcaactctttggcaggaattcagcgagagaatttacagaaagccatggaactggtgacaatcaactattcctctgacctgaagaatctgattttgtatttgttgactgaccaaaacaggatgcgaagtgtaaatgacatcatgcccatgattggtgctcgattttatactcaattggatgctgctcaaatgagaaatgatgtcatagaggaagaccttgcaaaggaggttcaaaatggaagactgtttaggctcctagcaaaattgggaacaatcaatgagaggccggagtttcagaaggatcccacttggtcagagactggagaccgttatctgttgaaactctttagggatcatctttttcatcaggtgacagaagcaggtgctccctggattgacctcagtcatataatttcttgtcttaacaagctagatgctggtgtgccagaaaaaataagcctgatttccagagatgagaagagtgtacttgtggtgacctacagtgacttaaagcgctgctttgaaaatacttttcaagaactgattgcagctgcaaatggtcagttgtagtatttgctaaaaaagcacgcaggacatggctaaagaccttaaccaatagcaaattgcactacagctgaacttttcatcatctcattcacatttgggaaacgaacaggagatgagcaaagctgcttgcacttcagtcaggtacactgttacttgaaaggaagaatgtttcacttacccaagagctatggctgccattggaggctgttatctgtgaagaatttattttagatttaggagcaccatcaggtgaatgatgttcctgcttttgttttttccacttgtatatgcactaattttaattttttaaagactttttctgatctttgaacttttgccacattgtatacttataatgggaaactttgcaaggacatttttgggaagcaatgctgggcagcgtttttgccattgagggttgcagaatttgctctttttgggatgggttgccctgaataacattacggaccaggtaaataatttcatagaagttcagtatagtacgtaattcttgtaagagtatcgtatgcaagctctctgtatgccacccactgttagttcaaattgagatttttgttttgttttgttcttaagaacataccaagaaaataccagtgaattgttggatatgaattccctgttagttgatttaaatcctttctgaataaagatcagataaacagtaactgaaggagcatgtatagctctttccttcaaattcaactagagcctttttaaaaagacatttgcctgctagtcagatacatttacatttatgcaaattttttaaataggagaaaattaagaaattgtgttaaaggcctaaagttcaggagtgtattactttaggttctttccagtttgctggtttttttttttttttttttttttttttttgggcgggggggaggtttatgaagttttgctctttgaaccacagctttattatggtcctttacactggagacagacacagagacactgttcagaagatgaactaaactcagcagtggtctggtatcaagagctttctgatgttttacagcctgaatttggagggataacgatctgctgtgcctttgcagtcactgcttagcccaaagtaatagtacttttgataataactcactctgtgcgatattcctgaataagtccatctcaaaagtttgggattttcctcctcttaactttcttaatatttggacatgcagttgtcgccaaacttgggtattcatggaatttctagtaaatgaaatacctatactttgatactgaagactgccaaatacataggaattttctttcttaaaaaacagtaatgaagactatatctcctttcccagcactgaatgttttactagcactgggtgctcaccatgcaactgaagaaaatgtggaaactcaaaaggtcaggacagacttccaagcacttgcaactgatgttactgtcttcaattttaataattacacatatttgtatatttcagagaagtttttaatatttctctgtccactttttataagctttaaaatgattttctctgccttgagatttgcatcaagaaaaagcacctctcttcacctgaaagctttgaagactagagacacgctttacacgttttaacaagtatattgagtccacgtttggtagcatcagttgttgagttaaaaagaaaattattgcatttgatctggatggattttaaaagaatataatgttcaatattaaaaggataattcacatttgccaccataatgttcttttttatgtaaaaagaagaacttggagacattaacatgaaaaagtcttttatcattagctcatgtatttgaggaagagcagctgtctttttatatgttttttgacaaatcatattgtattcttttgtacaaaaaagaactacttgtattctagaagaaatatgaaatgcttaatttataagcgggctggagattttttccaatattgttttctttgaaaatgaaaggggatcatctattttagttttggggtctgggaactttttgaaaatttaatttgtggaccaatgttttgtgaaagctaaagagggcaggggttaaaatagggcttgaatttctcattctgtatagaccagcaaacttccctgtgcaaggcaagtttacatcacaaatccaagaatgtttgcatcctaaatgctagtttgcttcagcccctagttaacctcaggacttggtttgcatataaaaggtagacagctgatatgttttcatgaataaatattgtcagccagaaaaggttggtgtcaggtaatgcatatttttttaagctttgttttatatttatttttcatttagtttttattgggaatggttttcaaagaactctcagttctgcctaggtgtttttgggggagccctgttttccatagtgtaattccatttaagaggttgtctaaaagtctttttaattaatagaaagattttaatatccaagagtagtcaaattaaggatataaactttccacaccttcctgtcgtgacagataaaagcacagaaaggacaacccttgaaatcatgtaacgttggtcatttcaatattttgtacctgttttaaattctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagataaatttgtccttttcttgcacgtgttcatataacaagatgatgattatcttatgattggattttaaaagattggttatttcctctgtattttggaggaatttttgtatttggatgaaatggcagcagatttattcattaatttat

SEQ ID NO: 461404 - DNA, 3469 bp, Homo sapiens
gtctgggaggtgtacccaacagctcattgagaacgggccatgatgacaatggcggttttcaaggcagaaacagcagcagctggaagtcaagaggagtgctctgtggaggaacacacccacaggcaccagcatgccggcaggccactgactggcaaaacaacgcggtgtttggctggggcagtcggaggagcgctcgggccgccaagcagaccgactccagggaaaaccatctcccttctggctcccccatctgctaagagttgtgatgattgtactatgaatatgcaggatgttaccattggaggaagctggattaaggggaagaaaacgagtttttatggtgtcaccagccatgggatctctggggacccagtgtcaccaattctgcctccctccttagcgttttggtggggctttcctgttcttgtgggtgtcctccaggggagactggtcctacagggggcccagggctgtgggagataatgctgaaattaacatctttggatatacaattctctgcttctgaagaatgaaaagataaataacagagctaagaaagggactgatgaaacttacaacagcaggtctcaaatttttggtctcaggacccctttatgctcttaaaaatgattgacagcctccaagagcttttgttcatgctttggtaaggctgtgagagcacagagctgaattagggatcttggacttcaagttactgactagccccagcactcgccaagctcacaaagaagacagaaacgaggcaggtccttcaggaggtattccagaagtcactgttatcataggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaagttaaaaaaataaaaaaagtttatatggtaaaaaaagttacacatctgctttatataagtgtaatgtgtactatctccaccgaaggacaaccactatcttgacttctcatcttgcacattaatgatttgcatgttttgtctttaaataaatggaatcacatagcatgtatgctttttggttctgacttattttattcagcgtaatttttgtaagactcattcatattgttgcatgtagttatagattgttcattctcagtgctgtattgaatcccgttgtgtttatatgctacaatttatttatcccatctactgttgatggacttgtgggtagttttgagtggtgtgctattacagagctgctacgggaattcttgtgtgtatcctttggtgcatatttgtatgcatgtctcctgggcattaacctaggagtggagttgctgggttgcaggtggcaatcaacttttgatgtctcactcttaaatatgaacagacagccaaggtcacccagcatttgaggaatgccctctgcgtaaaataaagacacaagcaaacacacactcagcaaacaaaccaacaaatatgagtgtgcttagtcccaaggagcctcaccctttccctcgcctgatactcctgttaccttcctcacatgtcgctataagaataaacatcgtagtggctccagtcaccatagctggactcatagattggatgggatgtacagttgggtcatcagacaggtttgtctcatttctccacttttgaaccagacgctggcatacttttcctttttggccttggtgtcatacatggagacttttctcagctttggtacacactgtcctggttacatccattacaccacatgccacgaaggcagtgctggctgcagagccaaatgggcggtttcccagaggagggacaactgggaggtggacttgttggttttggccaagatgatgttacttctggcttctccagttggatgtatgacctagaggcctgattcatcaagagagaagtccaaatcttgctaggaggaagaagtatagggaaaatcatggttataagctgcatttggctataggctagtttggaccttgttggaggtaatatttacccagcacatgttgttggaattgatgcagttataataaagctggttcttgttcttggccattaattccagagctctgtcctgaattaacagacctgtagagattgtgccacggaactgttttaatctggtgtagtctttgtaaaaagaatatttaaggactatggggaaagaatcaatgcttttccaatactgaacctttggcctggttccagggaggggtccttgccccaacctccatctttgaagggatggtgtagagaacaaaagcgtggctgaagctgatgatgccttcattagcacaggatcctgagggctgggaaaggaatggattgagtcagagacacagtgcccagctggggacatggagctggcccgtggtgagttctaaaggtatgaggaaggaagccaaccagtgaccactctatctcgggtggagaaaactttgggaaaggaaactctaaaactttacttttggggtgcccattccctggagtcccctcaccttgggctcttgttgggttattgtattaatctggcagggctgctgtaacacgataccacagactggatgacttaaacaacagaaatttactcacagttctggaggctagaagtccaagatcgaggtgtcagcagttttggttttttccaaggcctctgtccttggcttgtagatggcctttcctctgtcttcacgaggtgagtcctcatcactcaatctctgttaaaatgtcccttccttcctgaccacccagcagtgtggctccccaggaagtcagttttaaggttttaatggggtccccttggccacaaggggatccattcagtcaatgggggggcttaggatttcaagtttataccccaaagaacaaggcagattctagtttcttaaggctcacaaaatggaaagagcccttccttattcagctcttctactgctgtgttagtccgttctcacattgctatcaagaactacctcttctctgtccccatcagcggttagcacgctatctatcctccagcacctgctacgctgaatcgggcccagggtctggactggggagggtggctagcttctgaatccccagaacaggccaagctgcctcctcttctgacctcctctactccagcctagcaggctgggacacaagacactctggaacggctggaaggactggttctcctggggacatcctccacttcaagtacatactgaagcaggtcctggccaccagcgtgtacctcaacctcctcgccaggcccctcaactccaaggctggggggctgctggcagcttcaaattcattcccaagtacaagatgaaaattcagtctaggaagatggctccccc

SEQ ID NO: 461405 - DNA, 3017 bp, Homo sapiens
cagatacaacagtggtctcataagattgcagtggagctgaattacatagcctagtgaggtcatagctgtggcaacgtcatagctcaatgcattactcacaggtttgcggtcatgctgatgtaaactaacctactgcgctgccaggcttataaacgtctagcacatacaattacatacagtgcataatatacttaataacaaatgactatatgactcctttgtgtatttactatactatacttttcattgtcattttagaatgtatttcttctacttacaaaataaaaaagttaactgtaaaatggccttaggcaggtccttcaggaggtattccagaagtcactgttatcataggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaagttaaaaaaataaaaaaagtttatatggtaaaaaaagttacacatctgctttatataagtgtaatgtgtactatctccaccgaaggacaaccactatcttgacttctcatcttgcacattaatgatttgcatgttttgtctttaaataaatggaatcacatagcatgtatgctttttggttctgacttattttattcagcgtaatttttgtaagactcattcatattgttgcatgtagttatagattgttcattctcagtgctgtattgaatcccgttgtgtttatatgctacaatttatttatcccatctactgttgatggacttgtgggtagttttgagtggtgtgctattacagagctgctacgggaattcttgtgtgtatcctttggtgcatatttgtatgcatgtctcctgggcattaacctaggagtggagttgctgggttgcaggtggcaatcaacttttgatgtctcactcttaaatatgaacagacagccaaggtcacccagcatttgaggaatgccctctgcgtaaaataaagacacaagcaaacacacactcagcaaacaaaccaacaaatatgagtgtgcttagtcccaaggagcctcaccctttccctcgcctgatactcctgttaccttcctcacatgtcgctataagaataaacatcgtagtggctccagtcaccatagctggactcatagattggatgggatgtacagttgggtcatcagacaggtttgtctcatttctccacttttgaaccagacgctggcatacttttcctttttggccttggtgtcatacatggagacttttctcagctttggtacacactgtcctggttacatccattacaccacatgccacgaaggcagtgctggctgcagagccaaatgggcggtttcccagaggagggacaactgggaggtggacttgttggttttggccaagatgatgttacttctggcttctccagttggatgtatgacctagaggcctgattcatcaagagagaagtccaaatcttgctaggaggaagaagtatagggaaaatcatggttataagctgcatttggctataggctagtttggaccttgttggaggtaatatttacccagcacatgttgttggaattgatgcagttataataaagctggttcttgttcttggccattaattccagagctctgtcctgaattaacagacctgtagagattgtgccacggaactgttttaatctggtgtagtctttgtaaaaagaatatttaaggactatggggaaagaatcaatgcttttccaatactgaacctttggcctggttccagggaggggtccttgccccaacctccatctttgaagggatggtgtagagaacaaaagcgtggctgaagctgatgatgccttcattagcacaggatcctgagggctgggaaaggaatggattgagtcagagacacagtgcccagctggggacatggagctggcccgtggtgagttctaaaggtatgaggaaggaagccaaccagtgaccactctatctcgggtggagaaaactttgggaaaggaaactctaaaactttacttttggggtgcccattccctggagtcccctcaccttgggctcttgttgggttattgtattaatctggcagggctgctgtaacacgataccacagactggatgacttaaacaacagaaatttactcacagttctggaggctagaagtccaagatcgaggtgtcagcagttttggttttttccaaggcctctgtccttggcttgtagatggcctttcctctgtcttcacgaggtgagtcctcatcactcaatctctgttaaaatgtcccttccttcctgaccacccagcagtgtggctccccaggaagtcagttttaaggttttaatggggtccccttggccacaaggggatccattcagtcaatgggggggcttaggatttcaagtttataccccaaagaacaaggcagattctagtttcttaaggctcacaaaatggaaagagcccttccttattcagctcttctactgctgtgttagtccgttctcacattgctatcaagaactacctcttctctgtccccatcagcggttagcacgctatctatcctccagcacctgctacgctgaatcgggcccagggtctggactggggagggtggctagcttctgaatccccagaacaggccaagctgcctcctcttctgacctcctctactccagcctagcaggctgggacacaagacactctggaacggctggaaggactggttctcctggggacatcctccacttcaagtacatactgaagcaggtcctggccaccagcgtgtacctcaacctcctcgccaggcccctcaactccaaggctggggggctgctggcagcttcaaattcattcccaagtacaagatgaaaattcagtctaggaagatggctccccc

SEQ ID NO: 461406 - DNA, 1163 bp, Homo sapiens
  misc_feature (1029)..(1029): n is a, c, g, or t
  misc_feature (1070)..(1070): n is a, c, g, or t
  misc_feature (1084)..(1084): n is a, c, g, or t
  misc_feature (1109)..(1109): n is a, c, g, or t
  misc_feature (1123)..(1123): n is a, c, g, or t
gtctgggaggtgtacccaacagctcattgagaacgggccatgatgacaatggcggttttcaaggcagaaacagcagcagctggaagtcaagaggagtgctctgtggaggaacacacccacaggcaccagcatgccggcaggccactgactggcaaaacaacgcggtgtttggctggggcagtcggaggagcgctcgggccgccaagcagaccgactccagggaaaaccatctcccttctggctcccccatctgctaagagttgtgatgattgtactatgaatatgcaggatgttaccattggaggaagctggattaaggggaagaaaacgagtttttatggtgtcaccagccatgggatctctggggacccagtgtcaccaattctgcctccctccttagcgttttggtggggctttcctgttcttgtgggtgtcctccaggggagactggtcctacagggggcccagggctgtgggagataatgctgaaattaacatctttggatatacaattctctgcttctgaagaatgaaaagataaataacagagctaagaaagggactgatgaaacttacaacagcaggtctcaaatttttggtctcaggacccctttatgctcttaaaaatgattgacagcctccaagagcttttgttcatgctttggtaaggctgtgagagcacagagctgaattagggatcttggacttcaagttactgactagccccagcactcgccaagctcacaaagaagacagaaacgaggcaggtccttcaggaggtattccagaagtcactgttatcataggaggacagctccatgtgtgttattgcccctgaagacagtgggacaagatgtggaggtagaagacagtgatactggtgatcctgaccctaacgtgtgtaatgtgtgtgttcgtgtcttcattctaagaaaacgttttgtacagatgtacagtgtgtttgagtttaagctaagtgttatttcaagagtcaaaaagttaaaaaaataaaaaaagaagcggcccttncctttagggagggtaatctgatcctccttcctgctcctgcnctcggcgtcggtgngggacggtttacttcctcaaggggnattccggtttcccnaatcggggataccccgaaaaactttgaccaaggccccaat

SEQ ID NO: 461407 - DNA, 436 bp, Homo sapiens
tcattgggagcacctgataaaaatgccacggattctttgtagtcaaagaagatggccacggagacagcagcgtggtcagagtggtaggagccggccatcagcgagagctgctccatgcctggctgctgggtgctacagcctgtggcccactggcttgcctcactgtggttggtggtggcggtgacagagactgcagcacgaccaaagtggcttttctggctttgcccgcccagctgctccatgccaggaggaggaggagacacctagagcctgcgacaccacggctcgcctcgctgcgggagggtggcatcaacggagactgcagtgcaccagagtggagggcaggtggctgcagccagggttgggggtcaggcttacagcaatggacgggctgcagcagtggccaggtggtaggagccttgtagggagggctggc

SEQ ID NO: 461408 - DNA, 447 bp, Homo sapiens
agctgaaggcggcgggagaccgagtcgccgccagcgtcggcgccgctttgtagtcaaagaagatggccacggagacagcagcgtggtcagagtggtaggagccggccatcagcgagagctgctccatgcctggctgctgggtgctacagcctgtggcccactggcttgcctcactgtggttggtggtggcggtgacagagactgcagcacgaccaaagtggcttttctggctttgcccgcccagctgctccatgccaggaggaggaggagacacctagagcctgcgacaccacggctcgcctcgctgcgggagggtggcatcaacggagactgcagtgcaccagagtggagggcaggtggctgcagccagggttgggggtcaggcttacagcaatggacgggctgcagcagtggccaggtggtaggagccttgtagggagggctggc

SEQ ID NO: 461409 - DNA, 2068 bp, Homo sapiens
tgataagggaagaaggcctcgagtgagcatgcatacaacttcagaaaacactgatcgtgcggctcctcccaagtgctggcaggccactgtgcatgtggacagcccaccccaagggaagaatcaggggagaaaggtgcactccacccgcctgggaagcatgctgatgtataaaaccccaaggattgtgaggcctcctcagccatgtggaactattcctgagcttggaactctgaacacacattcagctgtgtctgccatacagggtcattctcagagtatgctgaagttattgctgtcaggtgcgtttgccatatactcagggacctgggtcccttccttcttagtctccatcttctccaggagccagaaaaaaaggagagagagagcatcaggtggcactgtttatgggcctttcatggaagtgacacctggggttacttctgcttatgttcctttggacagaattcagttgaatggtcatactagaggcattgtgccaggctttgcaggataaaaagaagttagagacagggactttggatccaagtcctccctgactcaaaacccagagaggcagaggatgcttgccacctttgactagtcctatctcctccaaagggtccttttgatttattagcaagaagccatcttctgaccacaaagacaagatttcaaagttctcacccagttcctagctaaagatgtccaaagagacttctaagccaatgattttcaacaaggaaattgaagttgtatgctttgaagagaggggcttgattgggtggcatcttatgcttaagtgtgcatggaagagccatcctacatgcagcatgtgatgggcccccagggactgaggacttgtgtatgactgggagtctacgcagcttggcttcatatcagttcttgccatctcggatccaaatgctctccaggcatgaagtcatttcctccaagagatttgaagatgccccagaagaatcttaggctaaggtcactattcttaagctaaggtcactattcttattcctctgagaaaggtgaaaggtgggttgggtgcagtggctcacgcctgtaatcccagcactttaggaggtcgaggtgggtggatcacgaggtcaagagatcgagaccatcctggccaacacggtgaaaccctgcctctactaaaaatacaaaacttagctgggcatggtggcacgtgcctgtagtcccagctacttgggaggctgaggcaggagtcgcttgaacccaggaggctgaggttgcagtgagctgagatcgcaccactgcgctccagcctggtaacagagtgagactccacctcaacaacaacaacaacaaaaaggtgaaaggtgtttgatggatgaaaatagagctgaaccctaacttgtaaccactcaattttaactagaggttgtcaccaagtaagagatgcccatcgaccttgtgcacaaagctggcgctagtctatgaactgttggtgaagtcacactatgaaacaacgtctctaccacccattcccataccatcagccatcctgctctggcatatgagcaggggaattcttttccgtcctctctgaaggaacgaatagtctgaaatattgaattggaaaaatgctcaaggcatccattctactctcgtgggccccatgtagttatctgttgaaggcctcggatgtgccagagacaattcatttgttgtcattagttccccccacaaccctcagaagtgagtataccttcatgtcacagatgagattatgttcaaaacggtttagaagctgctcaaggtcacatacccactaggtgacagatttgaatccagaattgtactcctcaacacagagcccccttctcactatgccggagatgctgagtttcttggcctgggctgcagccccacacagccggttttgagctccccaggtgaatctactgggctccctgggctgagaaccactgctctacatcagccttcttacatgaatcaggggttttattccgccttgcatcacaggttcctttagggaagtaaaaaaaaaaaaaaaaaaaaaaaaagctacaag

SEQ ID NO: 461410 - DNA, 865 bp, Homo sapiens
cgtccccatgacgacatggcaatgagtcttccccagcaggcagatgccagatgcagtggtgaccacacctgccatctgggaggattccaggcagactctcactctgctgcccaggctagagtgcagtggtgtgattatagctcactgcagcttcaaacccctgggcttaaatgatcctcctacctcagcaacccaagaagctgggacaacaggtgcacccccagcccaggcgacatcaacggccagccccatacgcgtgaggattgcggcaccaggggcgctcaggattgggccgggctgcttctcagaagaggggacattgagcccaagcaggctgcactcctgcttggacggaaggtgcatgggtggggagggtaatcacaccaatagagacatggatggacttgtgcagaacataaatactctctttgcttatgtctatgttactcaaaggaaccatggaaataacaaattcccaattacaatgcagtaaactttaagaggagcagagtgagcttcgctcttttatggttggtgtatttccaaaaaacactttcttcttctttcccaattctttttctagtttctcctaaattggtgtttctttagatggaagccgtgtctcagaccataaaacactaaacctatttgaagcacttacgttaattattctattcataaaatctaggttgatccatctcatagcaaaatccgttagtataattttaccttcttctttttaaaaagccaacaaactataagtggtgcttctatgtagaaatatataagtagaactgagtttttacttatagaacttatatcaaatgatgataagcaaagtatttttattctataacctggattt

SEQ ID NO: 461411 - DNA, 787 bp, Homo sapiens
tgggacagccctccccctccccctgggactccatggcctgtgctgtcctcctgcccaagaagcttccctctgaggcatctcgggtccgggtccgtcctgctcacccagggccaggagcccccaggaggcccacggtgcacccccagcccaggcgacatcaacggccagccccatacgcgtgaggattgcggcaccaggggcgctcaggattgggccgggctgcttctcagaagaggggacattgagcccaagcaggctgcactcctgcttggacggaaggtgcatgggtggggagggtaatcacaccaatagagacatggatggacttgtgcagaacataaatactctctttgcttatgtctatgttactcaaaggaaccatggaaataacaaattcccaattacaatgcagtaaactttaagaggagcagagtgagcttcgctcttttatggttggtgtatttccaaaaaacactttcttcttctttcccaattctttttctagtttctcctaaattggtgtttctttagatggaagccgtgtctcagaccataaaacactaaacctatttgaagcacttacgttaattattctattcataaaatctaggttgatccatctcatagcaaaatccgttagtataattttaccttcttctttttaaaaagccaacaaactataagtggtgcttctatgtagaaatatataagtagaactgagtttttacttatagaacttatatcaaatgatgataagcaaagtatttttattctataacctggattt

SEQ ID NO: 461412 - DNA, 3159 bp, Homo sapiens
tgtgcctctgtggtatcgaatagtcagggtgcagggatcacagagatgtagtcgaaatggcgagcgatggtgcagtagcgtgattgtcgttgacctcagcgtctcttgctacatgagtggtagatctcgcgggtctccctatagtgagtcctgattacatctcgataacggcaggtaaagtctgcggttaatgaactcggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461413 - DNA, 2738 bp, Homo sapiens
cgatggtcctcagtcctcaaacctcttgtccttggcactgcggacaactctctgggtatcttcttcatcctcgctcagcaacaagggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461414 - DNA, 2373 bp, Homo sapiens
ctaccgatggtaattgatttgattgatcttctatgtatatgtattttctctgtaatgtattgtattgaattgacttggtgtacatctatgtgttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461415 - DNA, 3342 bp, Homo sapiens
accccccacctccctccacatatacgtatccacatatacgcttgtccccgcccccttgtggcgcgaaggccactgggagttgtagtctcccagtgtagttagtcggcgcttcccggaagtgacgcgaggacccgccttctctctcggcgtttccgctgtcagggcctgcggtgtgactcgcgggctcagctggttggtattttttgggcctcgtgcttcgtggtgggagacccaggtcgaggtccgggtggggccggtgaggggttgggcgtcgggaggtgttggctcgggcctcttcgcgtggccggtgacgccttggctcccccgcaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461416 - DNA, 2698 bp, Homo sapiens
  misc_feature (186)..(186): n is a, c, g, or t
  misc_feature (188)..(188): n is a, c, g, or t
gaatcgagttggtaccgtaacattcgtgtcaccccagacagtccatcccccagacgagccacaaagaaggacgtgcagttgtacttgaactggagagcaagaagtggagagtggaaaatcaggaaaatgtttccaacctggtgattgaggacacgaatgttcatgaacattcgtgtcccatatcanangctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461417 - DNA, 2719 bp, Homo sapiens
ggcactcaggctcctggaggctggtacagggcatcactccctgttccgcactcaacattgccctttcctgctgtggcgtttgtcacatgccaggcctcggggctcccgggccggtgactaactgtggcttctcctctccagtatggaatgctcctttaccagaattaccgaatccctcagcaggtgaaatgggaaagtccatttcacctgctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacattt

SEQ ID NO: 461418 - DNA, 886 bp, Homo sapiens
aggaggacctcaaagctccctctggccagagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaagctggcagcagaccacccattcctgaaggagatgcaagatcaaggggagaacctgtatgtggtgaatggaggtggtggagacggtgcaggagacaagggacatgaagtgaccctggaggcactcccaaaagatgtcctgctatcaaaggagaccgtgggcgccatcctctatttcgttggagccctaacagagctaagtgaagcccaacagaagctgctggtgaaatccatggagaaaaagatcctacccgtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtggcacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccacgtcc

SEQ ID NO: 461419 - DNA, 2028 bp, Homo sapiens
ttcacacaaccattcacaacccatggtctggaagctctctaacctaggatgtgttgcgggtgctggaaagttttaccagcaggagactgcatatgactattatctagacacaaatatgccactccctcctgtcaggtcttcccaaggtctgaggccctcaaccctttgctttttgaatgcagctgacttttcagacacattcacagcattttcatccaccctctgtcatgcacagtccaccacaatcctacactcaaaggagcacactcacctcttagggacccagtcgttagctcacagatgtagcaaatctgaggaggagctgactggcctccttacggctgggttgctgtcgtgctggttgaaatgtttgcactgggccggcggggagtggggcctttcaggactccctcattgtcctctggtgctctacagactcccatgggcagtgtgggaggcactgcccaagcggccctgggaacacctgcaagctccttcacagcctgaactgctcatcaactgctcagacctcctcaaagcataacttagttctagatactctggagtgttaaactaatactgtttttctttcctgaggagcaacgtggatgaacagaggctagattccagagcccagagacgttaatggatgtgcaggagatggagaaatagaatctacaaggaaagtgaaacgaacaagcttggaaagcaggaacgcttcaagaatttgatgtacagcaagatggttatttatcaaaaagagaaaagggcaagaaaaagttggggaagccaagttcaaatgtgctttatttatttggttattccttggtaataaattcatagcaataacccgtggtgtgttgataaatgtttggcaaacagctgtccaggaaaataaagaagccctgattagcagcagtcgccaatttctatggtgtaactgatcacatcatggctgttttccagctaccaagatgatacccctcactgaagagggttaagacatgatgtgcacaactagcttttgtgagctggtcaaagctgtctccagcataccctgaaataactagtatttatcatgattgcatgtcgcagggcaggattttgcagggtggaccctgagtctatgatttggatgcacttgatttattaagggcatgtttccatggggtcttgtgaggcagggagagaacaggacagagatgggaaggcaggcaggcaggggagtgatgccgaaggttgcttcctttgggagacttgggaggacaaactatgcctctgggttttcccaggtcttgcacagaaagttcttcaggatgtcacctattctggttgggagccctagcggtgtgctctaaagagctaacgtttatcttaactgttttgaattcagctcagtaggagatctcactgaaggaacaggcaaacagcgcaacttcctctgataaggctggagtgcagtggcgtgatctcggctcgctaaaacctccacctcccagccgcctgccttggcctcccaaagtgcccagattgcagcctctgcccggccgccatcccgtctgggaagtgaggagcgtctctgcctggccgcccatcgtctgggacgtgaggagcccctctgcccggccgcccagtctgggaagtgaggagcacctcttcccggccgccatcccgtctaggaagtgaggagcgtctctgcccggctgcccatcgtctgagatgtggggagcacctctgccccgccaccccgtctgggatgtgaggagtgcctctgcccggccgccccgtctgggatgtgaggagtgcctctgcccaactgccaccccgtctgggaggtgaggagtgtctctgcccggccaccctgtcccagaagtgaggagcccctccgcccagcagccaccccgtctgggaagtgaggagcgtctctgcctggtcacccatcgtctgggaagtgaggagcgtctccgcccggcagccgccccgtccaggaggtggggggcagccctcgcccggccagctgccccatcc

SEQ ID NO: 461420 - DNA, 2024 bp, Homo sapiens
ctgggcccaggtggaaggtgagtgcggtgcccgcactgtggtcatcctagatgtgtatgtttagcatgacattcttcagcagactggcagaaaagcgtctggaggaaggagtgcctttgctgattcttacaagggtatcctatggcctagcaccggtgctgcaggtgctccaggcagggcagctagagcagggtgtggcccgggcttgggtcccacctgaggagcacagcccagacactgtccgaggcctagaggctgccctgcagtaccagccacggagctgggccatccagggtttctccgtggaactgggcaagccggggctgctgcgggataccgtggaaggagtgggcaatccctgtcctgtaccctggcatgggggcggcctcctcatccctgggcaggtacaggccacagtagctgccgggcagcagccagagtgtgagccccagagctggcttcctggaggaggcagacgtgcagagagagaagcaacgctccgaggtggaggggtgcaggagttcttcctgtggtacctcccacccttaggaagcagaacgcattggctccgtttcacagatgccaccactgaggcttggagggggcagatccctctttgatcatgtttttgtgacctttgtaaaaggcaatttaaattctaattgtccttcccaccctttctgagcctcaaagatatctataagacaaggatgaaaattatgataatgttatatattatcctcttgtaaggattatgtaatatgtgtaaagtccccagagcagggcctgcttcattttctgtgtctataaaatggcgcaaaaaaaccttgctcttggacacgtttatcagcagttgtctacgtgcaatgtcgggggcgggggcgcttgttaagacaataagaaataaaggagaaaaacgtgatcaaaggaagtcacattcaccttgcatttagcgggggatttgtacccctcttttccaggccagcaaaccaaggctcagagagagctgggggtaaaactcaccccttgcccgagcaattgaggctccatcccaccagccagttagctccctgtccctgccacacagccacagcctagccagttccctttctgcctgcaactaccattgttgtgcaagaaaccaccccaaaatatagtggcacaaaacactgaccattttcttctgttcatggagtctgcggggctccagtcccctgggcatgctgccatccacttccaggtgtttgcacaagctgctccctagaattggaacacctctcatggccctcacctggagagggtctgttcctcctcacagcgccatccagtagacttttctggacaatggaaatgttccatttctgcactattcgacatgctgtccactagccaattgaaatgtggccagacaccaccatacctcctgctctgtctgggatggggtcttccacccaaccatgccagggtctgagagaggaaacaagccagtttcctgccctcaaggagttcccacctttctgttctgtcctcagttccctacgatctccttaaaaagcagaaccttagaattacgcactggacaaattcttagaggcctgatccaatttcccattgcacagagagagagactgaggtctggggaatgaactggacttagccacacagaacaggggaaaagagcctcaagccctccatcctcagtctgggattctggacaccacatccccccaccgcctaccccgactccctctacccccatttcctgtacctggctgccacactggtgctccctgactccctcttgggcacagactggtgactaaccaccctcagctgtgcccacggtgttcaaggaggactcgtatttaagaaatgaggggagacttcacccctttgccaggcagtcaacagttccccccacagggatgtaataattaccaagccaggcagcagaactttccctggagcctcgcccaacaattctcttgctcatatctcattggccacccctggctgcaggggtc

SEQ ID NO: 461421 - DNA, 914 bp, Homo sapiens
acgaggaagtggctcagatgattataaagcctgacaagcccccaagatctgcagttcacaaggaggctgatggtgtaaatccagttcaaattcaaagtcctgggcatgagaagagctatttttttagttccagtctaaagacagggaaaatgaaaattcctccttactcaggggaaggtgagcctttttgttctattcaggccttcaacagattggatcaaatctctatctcagtccaccaactcagtcaacccagaaacaccctctcagacacagccagaatgttgtaccaaatatgtgagcatctcgcaaatctcagagatattgccagctcagttccaggccacagcaacaaagcaaatattgcaataaaaatgaatgttgtgttagcaggcatgaaaacaatattaatctctttgaacatctccatcgaacttcttgggtgaccaggtgcattgccaataagcagtaatattttgagaggaatcttcatttctgggcatcgagtcccaatagtgggcttaaaatactcagcaaaccatgctgactatagaaaagtgacttgaaacagacatatgaaaatcacttgcacattgtgattacttacttcctcttgatgctcttggagccctacaactctgtgaagaagcccaagcaagcctgctggataacaaagggcatatggtccagatggctttgttgccctgatcaacagccaactagacactagacacatggaaaagacttcctggattatccaaccaccagccaacctaaaagcagactaaggatgcttgaaagagctccacagagattagctgagctcatgcagataagaactgcctagctgacccaaatcatagactaaataaagtgttgttgtttgaggccattaacttttggggtcatttgtt

SEQ ID NO: 461422 - DNA, 1662 bp, Homo sapiens
cagccccggctctgacccgccagccctcggaagaagcagaccctggccggtccatggcagtggcccgaggggcaccagcgcggagcaccagcgacccccaaggaacgacgttgcagatgatgctctaccaagagttggaaggactccccagggaatcccacaagacactgcgcttcctatgcctcctttccctcgtttaaaaaatggggataagaaggttggctactgctccgacagccctcacaatggaagagtagcacttcatttgtgggttaacaaagggcaacgctgaaatctccacttccactattgaatggaactgtgtcataatatctgttagaggcgtgcaaactcggccacaaggtcatggtcatacgttattgttggtcaaaagccgcagccctacctgaggctttgagagatatgaacaccaatgacttttcttttcctgactcccgaaataccaagaaaaagcaacttccccaaatggacagaaacagaaagtacccttggttgaacacagaggcctggttccagccatcgttagacgtgggaaggaactcagaccccctctcctacctcatccccaaccccttccccacacgtcaccctttcacagagaaggaaccagagccaccaagggctgagagaggacttgataaggattccagtcttctgtctcccctgtccccactttttccaccacaaaaatatggacatttggaagaagaggagaagagggaaggtacacactgtgcaaaggaagaaaatggcagaaatgctctggaatcaggaattcaggagcaagaatgacactgtgtgccagatggaaatgttggattaggagagcacttggaaaggcaaataatctgccagagaaattatgggatgcctgccttctgaaaatggaggaaaactgcaaaagagtggctcattggtgctcactcctagggctctgagcatcccaagaagccaacttggtcccatcgtacatcccctcagaagtaggcattctcctctccacctacagctgtggcccagatgtggagcctgcatgttatgccacgccgtcaacactgagttctgtctgcgtctccctgtcacagatctgatcagcacctgacacctatccattctccatttcccacctccccaaagctgctggaaaaactctgaaaggtgggagcatgcaccagtgaaacctgagttctttctgttcacatgaggtaatcttcccactggctggaagacacttcatttatacaaacagcgattactgtaaaagtgtattcatgttgttcatcacatgaataggacatgggagaaaaactatataattatcctgagaaaatgccccctaatgcaaattctctgtggttaggaataaaaggagactttgtcaacatgataaatgatatctatctcaatccagcagacaatgtgatagctaatgatgacttggaatgaagggacagatacggtccttaataacagaagaattcctataaaacaagggtgcccacaacttgaatagtttcaacaatattgtgaaattcaaagcaaaaagataagagagtcagaaatttgggaagcaaaagtcaagttcatcattatttgtaagtgatatgattgtctacctgagaaaccttagataagggactg

SEQ ID NO: 461423 - DNA, 1619 bp, Homo sapiens
  misc_feature (2)..(3): n is a, c, g, or t
  misc_feature (6)..(7): n is a, c, g, or t
  misc_feature (9)..(9): n is a, c, g, or t
  misc_feature (13)..(13): n is a, c, g, or t
  misc_feature (15)..(16): n is a, c, g, or t
gnnatnncnttantnnaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttatacattaattataaaacatatatcatttgctgcatatttggaataccttgagaactgaatttttccaaggttgcagaatctcaaggaaaatgtttcttaaggaattaaataggaatgtctcttaacatttaaaatattttctttaattctttttgaaataatactatacattgtagaaaaagtgtcactgaccttttcatcaatccttgctgacaatgtattaaacagtatacagattaaaaaataaaccgatgactataaaaaactgaactcaaaggttctggaattccagacctaggcatcccctgacaaaatcagatggggtgtattgactgggaaccaattttcatttggggttgggcaggcttaacaagtggctagttcccttctctgtcagctgtaacactggcacatgaacacagaagatttaaaggggtctatacctcacagtactataaccttgaatgtgaagg

SEQ ID NO: 461424 - DNA, 1150 bp, Homo sapiens
  misc_feature (2)..(3): n is a, c, g, or t
  misc_feature (6)..(7): n is a, c, g, or t
  misc_feature (9)..(9): n is a, c, g, or t
  misc_feature (13)..(13): n is a, c, g, or t
  misc_feature (15)..(16): n is a, c, g, or t
gnnatnncnttantnnaggattttaaacaagctgcactgataagccggactaacgggagcctttgtcacgccactgccatgtgccatcacagaattaatgagtttgaagaagctgtcaatttctttacttgggctcttaaaattaacccatgttttctggatgcttatgttggacggggaaattcttacatggaatacggtcatgatgaagccaccaagcaagcacagaaagactttctgaaagcactgcatattaatccagcatacataaaagccagaattagttttggctataatttgcaggcccaaggaaaattccagaaagcttggaaccactttaccattgccatagatactgatccaaagaactacctagcctatgaaggaagagctgtggtctgtcttcagatgggtaataattttgctgcaatgcaggatattaatgctgccatgaagatcagtactacagcagaattcttaacaaatcgtggggtgattcatgagtttatgggccacaaacagaatgcaatgaaagactaccaagatgcaattactctaaaccccaagtactcgctggcttactttaatgcaggaaatatctactttcaccacaggcagttttcccaggccagtgactacttctcaaaagctttaaaatttgatccagaaaatgaatatgttctcatgaatcgagctattacaaatacaatattaaagaaatatgaagaagcaaaagaagattttgcaaatgtaattgaaagctgtcccttttgggctgcagtatattttaatagagcacatttctactactgcttaaagcaatatgaactagctgaggaagaccttaataaagccctgtctttgaagcctaatgatgctctagtatataattttagagcaaaagttcgtggtaaaataggtctgattgaggaagctatggctgactataaccaagcacttgatcttgaagactatgcctcagttatatgattacatagactgtggttgctatagtagtttacacagctgttctctctgaaacggaaacatatttgttgtctaaaaggttctaccattttcattattgtattcgttatgcttagtcttccatataaccttctatgcattttaataaaatgtttgttataca

SEQ ID NO: 461425 - DNA, 1197 bp, Homo sapiens
ttctcccgtgcgcgggagaatgtcgctgggcagggcgtgactctaaactcaagccgcacgaggcttctcagaggttcctctcaccacaaagccccatcacagtacagaaggctttttgcaaaacagtgatttctcagcttttccgaagaggttcctaaatgtggctgtaaccctgacgtgagagtcgctcccgcccctacctacatcccacacatttcaggagtcccctacgtattctacaaaacacagaacgaccatatgagccacttcagtccttctcagcattaggtgactgatttacatcagaataaaacaagagtttcttgctggttttaatgtaattaaaatgcaccatccctgtatgttcccaaaggagtgggaggaaaagtgtttggacaggggactgatcgtcagtaggttttcacagcgtggtttataaaatcacttttaagctctcttccacctagctgtcactgagaattcggtttgagaggaaatgactttctagacgatttttcatctagatgatttttcatcatattcaaccaagagtctttctcatcctctagctctctgaatgtccagaaatgtaatagaaactctgcattgatttccaaaggtctaatttccggaggagccctaactgtcctgtcctgcctacattgcctgccctctaacatcctgggaatgggaagtaacactgggatcggtggcggcagaactgcggaccctaacaacttcagattgttgaaagggggaggggagaatggaagagaggaatggaaaggcaaaagaaaaaacatttgtctcggtgcaccccgtcgcacgctttgcacactcattaaaacgattattcacgacctgtcgagtgttttcgggttcattcacaggaaaggcttggaacgagggacagcaattcaagtcaacactgtccactacccctatgcacgtgaggacgagttgctgcgtgcctataagtcccgttcatccgatgctctggaatctcaatctcgacagaatgccaagaatgcttggtcctacaaggaccacgtcgtcgctacgttaacttcaagggcttggcacaagacaaaaaaaaaaaaaggaaaataaaataaataaactcaaaactctccctctgctcctcttttcaaccttctgcaaaactttttaagtcccaggactcgcccaccttctgtc

SEQ ID NO: 461426 - DNA, 1822 bp, Homo sapiens
acccggattgcgggaggaagggggtgacatttcaagatgatgtgagaggacgttttgtttggttgctgagcaacccagaatgcctctcacctcagtgcgcagggaacaatggtttttcagctcagggcttgagaagggcaaagagggaatccaaaagcagaaatatgggcaacccttcagaatgggccattgttcagctgggagcagaaagggatttgcaacagacaaaaagagaagtgtgacagccaaaaaagtgtctccagatattgctaaatgtcccctaaaggaaaaagagtctccgtgttcattcccaatgagaaaagaggactcagctgtctcccagcagcaaaagaccctctgtttctctggtttgctttcatttgtcattgaatttgggtcaccagcttatgcacatgccattattgaacgagggttcaagacaatggcttatgtgccagttcctctaactggttcagaaaggagaagaggagaaaaatcctcaaatgaaaacaagagctggtactggaagaaggtggaatcatttttggaaggtcaaacaacagaagcctgcttctctaacctagaatatatttataaaaaaagttcttagagacttaataatgggatggccacattttataaatgaagacatcaggtctcaaggatcttgagagaagcaacaactatagtttgtagcagagaccaaacactaaccaaaatttagctaccaagttttagatgacggaatccaaatttccaatattcaatgagtgatgacatttatactggactcaaagaaaagtgaaaacattttcttacacattcctaggatcattttgttttatacctgttgtttatttttaaatcttacttgatcaaaaagcaacctgtggtgcttgcaagaaaaacagattctcaagttactctcccatcgattaaaacttacaatgccaggggtatggtgaagaaatctgttattctgttatttagctagtttgtggaacaatgcatatgtcagcagttcacggcctcaggtgaatattaaaattacctggggagctgacgatgactggtctctcaactcagatcaattaaatcagaaccacctggaaacaggacttggattttttttttttccctctccttttttaaattctcaggtgattccaatatgcagccaagtttgagaacaagcatcttgtgtcatagagcagtggttctggagaactcgatataataaatacaggagcttagttcctaccctacttcactgcttttgctgctaataaatcctgcctgtgatatcacaatgcattgtagcagctggctcagagtcaagacatcaacacatgaatcagacaggatgagaggaggataaggctaaagacagaggctccagctaccttggtgacaaggaatggaggagaaaaggaacaggaaattttaataagattaggagggcttgcttttctgccaagtgagccgctttcacaggagcgataaattggaaatgttatctggcttgatatgccagtttttctgagaaaatcactctgccagtggtgacagaatggaagagctgaaaacatcttcttttttcaaagtcatatgtcacgaaccaaggagactccaaaaaataaattatggaagattatgaccactgctgccaaggatacagtgaaataggctgcatttgtaaccaagccgtggtccttttcattgcatcttgccagaatgaagaagagctgatctctccagttcctgttattccccttacattgcccacatttattgctcaataaaccacagaaatccttctgta

SEQ ID NO: 461427 - DNA, 3604 bp, Homo sapiens
acccggattgcgggaggaagggggtgacatttcaagatgatgtgagaggacgttttgtttggttgctgagcaacccagaatgcctctcacctcagtgcgcagggaacaatggtttttcagctcagggcttgagaagggcaaagagggaatccaaaagcagaaatatgggcaacccttcagaatgggccattgttcagctgggagcagaaagggatttgcaacagacaaaaagagaagtgtgacagccaaaaaagtgtctccagatattgctaaatgtcccctaaaggaaaaagagtctccgtgttcattcccaatgagaaaagaggactcagctgtctcccagcagcaaaagaccctctgtttctctggtttgctttcatttgtcattgaatttgggtcaccagcttatgcacatgccattattgaacgagggttcaagacaatggcttatgtgccagttcctctaactggttcagaaaggagaagaggagaaaaatcctcaaatgaaaacaagagctggtactggaagaaggtggaatcatttttggaaggtcaaacaacagaagcctgcttctctaacctagaatatatttataaaaaaagttcttagagacttaataatgggatggccacattttataaatgaagacatcaggtctcaaggatcttgagagaagcaacaactatagtttgtagcagagaccaaacactaaccaaaatttagctaccaagttttagatgacggaatccaaatttccaatattcaatgagtgatgacatttatactggactcaaagaaaagtgaaaacattttcttacacattcctaggatcattttgttttatacctgttgtttatttttaaatcttacttgatcaaaaagcaacctgtggtgcttgcaagaaaaacagattctcaagttactctcccatcgattaaaacttacaatgccaggggtatggtgaagaaatctgttattctgttatttagctagtttgtggaacaatgcatatgtcagcagttcacggcctcaggtgaatattaaaattacctggggagctgacgatgactggtctctcaactcagatcaattaaatcagaaccacctggaaacaggacttggattttttttttttccctctccttttttaaattctcaggtgattccaatatgcagccaagtttgagaacaagcatcttgtgtcatagagcagtggttctggagaactcgatataataaatacaggagcttagttcctaccctacttcactgcttttgctgctaataaatcctgcctgtgatatcacaatgcattgtagcagctggctcagagtcaagacatcaacacatgaatcagacaggatgagaggaggataaggctaaagacagaggctccagctaccttggtgacaaggaatggaggagaaaaggaacaggaaattttaataagattaggagggcttgcttttctgccaagtgagccgctttcacaggagcgataaattggaaatgttatctggcttgatatgccagtttttctgagaaaatcactctgccagtggtgacagaatggaagagctgaaaacatcttcttttttcaaagtcatatgtcacgaaccaaggagactccaaaaaataaattatggaagattatgaccactgctgccaaggatacagtgaaataggtacatcttgtatgcccagtaatgttgaaaattaatataaccttatttaaaaagcaatttggagatgttgaaagaaagcctgaagattaccaccatgcttcatgattctatccaggtgtcccacatatgagagccaattccaaagaaataactacaacttggaaaaaactatatgcataaagatgttcattatggtgttagctatagcagcaaaacaaaaaaaaaaaacacagaaaatgtttgcaagaattcccaaatagaaaattattaagtcagctatgacattttcccagtaggatattctgcagcacttaatatgaaagtcactaagtttacatggaaaaatacctgaagcataatcttaagttaaaataaatctaaatatacttatatgctatagttgcactttttaaaaaatatgacagacagcatgaaatatccagaataggcaaattcatagagaccaaaagacaggcatagtggttgccacaggctggaggaagaaaagaatgtggagtgactgctaatgcataaaatgggtttccttttggggtgataaaaatgttccagaacaagatatgggtgatggttgcacaacattgtaataatataataataacttgtagctaatggaataccataagaaaagaaaataagaggtatacagatgggaaggaagaaataaattatctttgtttgcagattatattattgcctatgtagaaaatcccaaagaactggacaaaaaaatccagaactaataaattattatggcaaaatcaaagaatgtaaggtcattatacaaacatcaatttgcccccaatatggtagcaatgaacaactgaagtttgaaattaaaagtaagatataatttgcatcagcaccaaaaaaagatctcacaaaatgtgtgtaggatctatatgagaaaaactataaaactctgatggatgacatcaaagatcatttaaataaagaggtgttcattttccttgatagaaagacttgatatagttaagatatcaattcctcacaactttacaatctgtagactcagcacaattactaccaaaatatcaccaagttattttgtgaatattgacaatttgattctaaagtttatatagaaaggcaaaagaaacaactatataactcaagactgaagaataaaaaagtcagagaactaatgctatcggatattaagacttaccacaaaatgacaacaatcatgttaacaaggtattggtgaaagaatagatgaatgataaatggaagagaatagagtacccagatgtagacccacacaaatatagccaactaatctttgacaaatgagcaacaataagacaatggagaaaggatagtcttttcaagaaatggtactgaaacttctggactttggtatgcaaaaaaaagagaatcttttataaaaattagctcaaaatagatgttacacataaattgcaaaattacaaaacttctataaggtaatgtaggagaaacctgaggtgaccttgggtttggtggtgagtttttagattcaacatcaaaagcacactcagtaacagaaacacaatacaagtcatgtatctgttaaagaacttttatccaaaatgtacaaagaactcttaaaactcaacagtaagaaaacaaataacctgattaaaaatgaacaaaagatttgaaagacacctgaaaaacatatacagagagcaaataagcacacaaaaagatgctcagtcccatatgtcattagcctttagaggttctctcagcaagcatctctttggtagtaaattctcctagtcttttcatggtctttaatagaattttttggggtaatttttgcctgtgtgcttgctttcagcaggagttggtattaacagcagtcgtgcacgtgcctaggtttaggaggactcct

SEQ ID NO: 461428 - DNA, 1274 bp, Homo sapiens
cccaccccaatacacatccaaacccaaacagtagctgaagagtaacttcaaccatagactctctttccaggcccacgctcccaccggtgagtgcatgtagtcatctgggcacctaccgtgtgctccttggatcccaggatgagcagtgaagaaaggatggcgggggatgaaagagatcccctcccaccctcatcccactctcaaggctctagctggaaggcagaggcaacactgcagatgaagttctgaaagtgagatggtgggcaggtaaaggagctgccagccccatggtgccatggctgtggggttttaagcagcacccaccgagtcagccagaaacctctgattccacctagaaaaataagggaagagttacaccaggaagcaagataatgaaactcatcttgaagcttaaacgtggacggagtggttcctcagtgccagacagctccccgcaagcacataggagtttaatagctgtttattcttccatatagactaaaactacattcatcagaaaaaggggagtaattcatttcctatcccaattatggatatagcagactgaagaatattttcaaagaaatacagtttattatgatcacaaacttgacctagagtaaactaagatgtaaatggatatttacactggatagtaattgttttcaagttataaaaatacttaagtttacaatggacatttactacaaaacaacctaatgccacagtgccaagttgttctgtttttattgggtcttttactcctatgatcctatttctaaatgtttatatgttctaatttgtgatatgtctgaattcactgaatgggatgacatatgaggaacatctagtgccatgtctggtccctattaagcgctcaataaacatcagctatactattattaattacacattcctgttgtgggtttctctttcattccacccatataacattcccggggatgcctggagccatacaccacctagtggttcccagctcaacaccagcaataaggcacctccaaccaagatagaagagccctctcctccaggacaccttagactgaggaaacaagaaataaaaggcccagcaggagtctttccagaggagatagtgattaacaggagtcggtactcatctcctatgctcattaaagagctagatcaccaaagtattgttaccgcaacaccaagacaagttgacaccaagcaaggattatctttcatctaacaaaaacaaacctgatggcaggccggcaagttttctcctctct

SEQ ID NO: 461429 - DNA, 727 bp, Homo sapiens
cccaccccaatacacatccaaacccaaacagtagctgaagagtaacttcaaccatagactctctttccaggcccacgctcccaccggtgagtgcatgtagtcatctgggcacctaccgtgtgctccttggatcccaggatgagcagtgaagaaaggatggcgggggatgaaagagatcccctcccaccctcatcccactctcaaggctctagctggaaggcagaggcaacactgcagatgaagttctgaaagtgagatggtgggcaggtaaaggagctgccagccccatggtgccatggctgtggggttttaagcaggtgaggtacacagatggtgacacagggagggggtgtgctgagcacagtggcagggtacagtcaagtccagtcttggggtgggatacagaccaggtgagctgggctgaaaggatccaaatgtgagtgggaagtgatgggaagtgaggtggagcgtccagtgagatttggttgctgggacaataaacagagagccatgatgggttttttcaaataagaaaatgccatgtccaatgctggatttcagaaagaggcttagggaagataccaataggattactttggggaggaaagacttggaatccaaaggctggggccccttgtggttatcccagcttgttctacaaaagccgacacgagaggggtgactcggagaagggagggaaaggatcaaatggaaaattgctgtggag

SEQ ID NO: 461430 - DNA, 2970 bp, Homo sapiens
cgtggcaaccaccaagactagctgaaaaccaagggtgactcctttcattagcctttcccctgagccttatctgccccagctaccagccagaacacaaaagctacatgtctgattagagtatacttagctaatagggaaccccctctcacagagaagttctatggggatcaccaggtctctcttacccctcagctgcccctaaggcagggaatttctccagaaggccaccagccagcagaattaagtgttattccagtgcctacccaggcctgacaacatcatgctcccaggacagcagtgacaacactcatcaccccaggggcccacagaagatgcctagagactgaaataggagctctcatagcataagaagacaaggcaaatttcatctgcaacactgaggacaaacaaaggcagttcctgcagaaacgtcacagctacctgggagcctaagtctgaagcaattaggcagggctcccagggaaggctctgatttttcaggtcaggccctagggtctcctggagggtccaaaggtagactcccctgcccacagaacctggcccatccctacagggagaactatttttagaacacttggagaattttcagagcttttacaggttgaagatggttcttggggggagcttctgggagaagctgtctctgactctgagggtgtggggattgttctttcttcccgctcccatagtcccctgagccttggccaccctggattcagagcactgtgaggccactgccttatttcttgtctatcttcctcttttccacagactgtgggctcccaaagagccaggcttatgttcttcttgcacccccaacagagcacactgagctgggggctgcgatgctgaaggcagctgtccacatcacttgctctctgcgcgggccggtcagctccagaggaattcatctggggcaggcccaactcggcccgctgaattagcctccacgatccccgggcctccccggcgccagggggcgctgtaaacgttccgtccctgcccctgcggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattgcatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtggggtctctggcccctcagggacttgagattatttaagtactagttcctaacacgttctggaaaataaaaataactctgggttaaggtttaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatggcgaggccccgtctctactaaaaatacaaaaaaaaattagccgggcgcagtggctcgcgcctgtaatcccagctactcaggaggctgaggcaggagactcgcttgaacccgggaggcggagtttgtactgagccgagatcgcgccactgcactccagcttgggtgacacagcgagactccgtctcaaaaatgaaaaaagaaaagacgtatcggaagggagtgccgcccgcttactgacaaccactgctgggcaccggagagaccccagcagcaacatgattgggccggtgggggattccggttccccagtacctcaagccgcgcgggaaactcggtgactcgcaatcccctcgcccttccgcattgc

SEQ ID NO: 461431 - DNA, 2324 bp, Homo sapiens
cgggcgcacctaagctgtccccgcagagacctgcagggagctcgcggcggaggacccagagggaggcctgcggtggctccagcccagactccggccccgaccgcagcagaagtgcacgaggtctacggtcatcagggtcacaaccaactgtgggctcccaaagagccaggcttatgttcttcttgcacccccaacagagcacactgagctgggggctgcgatgctgaaggcagctgtccacatcacttgctctctgcgcgggccggtcagctccagaggaattcatctggggcaggcccaactcggcccgctgaattagcctccacgatccccgggcctccccggcgccagggggcgctgtaaacgttccgtccctgcccctgcggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattgcatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtggggtctctggcccctcagggacttgagattatttaagtactagttcctaacacgttctggaaaataaaaataactctgggttaaggtttaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatggcgaggccccgtctctactaaaaatacaaaaaaaaattagccgggcgcagtggctcgcgcctgtaatcccagctactcaggaggctgaggcaggagactcgcttgaacccgggaggcggagtttgtactgagccgagatcgcgccactgcactccagcttgggtgacacagcgagactccgtctcaaaaatgaaaaaagaaaagacgtatcggaagggagtgccgcccgcttactgacaaccactgctgggcaccggagagaccccagcagcaacatgattgggccggtgggggattccggttccccagtacctcaagccgcgcgggaaactcggtgactcgcaatcccctcgcccttccgcattgc

SEQ ID NO: 461432 - DNA, 2273 bp, Homo sapiens
cgggcgcacctaagctgtccccgcagagacctgcagggagctcgcggcggaggacccagagggaggcctgcggtggctccagcccagactccggccccgaccgcagcagaagtgcacgaggtctacggtcatcagggtcacaaccaagcacactgagctgggggctgcgatgctgaaggcagctgtccacatcacttgctctctgcgcgggccggtcagctccagaggaattcatctggggcaggcccaactcggcccgctgaattagcctccacgatccccgggcctccccggcgccagggggcgctgtaaacgttccgtccctgcccctgcggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattgcatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtggggtctctggcccctcagggacttgagattatttaagtactagttcctaacacgttctggaaaataaaaataactctgggttaaggtttaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatggcgaggccccgtctctactaaaaatacaaaaaaaaattagccgggcgcagtggctcgcgcctgtaatcccagctactcaggaggctgaggcaggagactcgcttgaacccgggaggcggagtttgtactgagccgagatcgcgccactgcactccagcttgggtgacacagcgagactccgtctcaaaaatgaaaaaagaaaagacgtatcggaagggagtgccgcccgcttactgacaaccactgctgggcaccggagagaccccagcagcaacatgattgggccggtgggggattccggttccccagtacctcaagccgcgcgggaaactcggtgactcgcaatcccctcgcccttccgcattgc

SEQ ID NO: 461433 - DNA, 1548 bp, Homo sapiens
  misc_feature (449)..(449): n is a, c, g, or t
  misc_feature (451)..(451): n is a, c, g, or t
  misc_feature (455)..(455): n is a, c, g, or t
ccacctcccaacaccagcagccggaagctctgtccctgggggctatgagaatgcagtgtgaacctaccagcaggctcttgctgcacacacgaggccagcagggcttccgtgctattggcaaactgctaagtgcttccatcaacccagtgcccagtggggaaccagcgcctgttacttacgccatcagctgtccagtaattccgaaccttgatcttggccagatggaagtcccccagctgtcttgtatggaaaaacccaaaccaggggacttttctcagccccagccgcctcctcttggctttctacaatacctattcactctccagtgggacaaaactcacagctgctcccaaacgcgtccacgctggctcgacccagtgccttggcacaggctgggcctctgcttgcttgcaattctcttcttaaccttctcaatctggggaattcantnaaanccaagagggaggaggtggcttttgttaagggggaacgatgagttcaaggggttctgacttattctggcaagtttctccagctctacaagaacttctagtgctctgggcagctgcgaggggtcaagaaaccacatccccaaatccagcgggatctcagagagaaaggctgatgggaagctgcccagggctgacctggcacatgctgggaaaacccctcggtgccagggcaggaggcagagcgtctgcagctcctccctccccaacacaggggagacagggttttgccttgttgcccaggctggtcttgaactcctgacctcaaatgatccgcctgcctcagcctcccaaagtgctgggattacaggtgtgagcctctgtacctggccagattttgttgttcttcccctccctccactcatacccttaacacagatttaccaagggcagagaaaatgcatgggaatacacagccaagaagcaatccagtgccccttccactcacagctaagttcctgttgacgaggcggcccagctccccaggcgtggctgtgttccggatatccacatcgtggggcgacacataaagctttgtgtcattcaagtcaaagaactcgacttctgtgagacccacccaccacgagttgccccagttggacaggatctccatggtcacgtagatggcatctttgatctcgtctgccctcattctctgtttgtccttaaagaagagaaaaataacaccaaaggattaagtcatgacaggcttgaattcggctctgcctctgccaccactgccttcaaaaagttagttaaccttcagggtctcagtctctccatctgtacaatgaggataagaatagcacccactacctatggttattacaatgattaaatgaattcatactgtaaagcattcaaaatagaggccctgtgtaactggcactctgtgagcattctgtttgaaagtttacaaataaataaaaatgtctaaaaagcattgaattctgcctgaacatgcacgtctctcccccactactcagtgttcggtacccagaagcttgtcacgacatctgctgaattgagtaggtgttac

SEQ ID NO: 461434 - DNA, 641 bp, Homo sapiens
ctgctgttaccgcccttggttcatggcttctttcacttggaaaccccaggagctaagttcctgttgacgaggcggcccagctccccaggcgtggctgtgttccggatatccacatcgtggggcgacacataaagctttgtgtcattcaagtcaaagaactcgacttctgtgagacccacccaccacgagttgccccagttggacaggatctccatggtcacgtagatggcatctttgatctcgtctgccctcattctctgtttgtccttaaagaagagaaaaataacaccaaaggattaagtcatgacaggcttgaattcggctctgcctctgccaccactgccttcaaaaagttagttaaccttcagggtctcagtctctccatctgtacaatgaggataagaatagcacccactacctatggttattacaatgattaaatgaattcatactgtaaagcattcaaaatagaggccctgtgtaactggcactctgtgagcattctgtttgaaagtttacaaataaataaaaatgtctaaaaagcattgaattctgcctgaacatgcacgtctctcccccactactcagtgttcggtacccagaagcttgtcacgacatctgctgaattgagtaggtgttac

SEQ ID NO: 461435 - DNA, 2465 bp, Homo sapiens
gagttattctgttgaagattggagacagtgttgaaaggatcatggggatgagcacatggcttcctgacaatgtcacctttgaggaaggcgccctgattgatccactttctgtggggatccatgcctgcaggagaggcggagttaccctgggacacaaggtccttgtgtgtggagctggggcaatcggggtagtcactttgctcgtggccaaggcaatgggagcagctcaagtagtggtgactgatctgtctgctacccgattgtccaaagccaaggagattggggctgatttagtcctccagatctccaaggagagccctcaggaaatcgccaggaaagtagaaggtctgctggggtgcaagccggaagtcaccatcgagtgcacgggggcagaggcctccatccaggcgggcatctacggtcacagctgactactgcttgttttgtctcccagacctaggaacagataagctgccaatgcctgattcgcccctcagcgacccaccagccacttatgggaagttggcaggaattgcccagcggccttgggagctgaggaagcagtgggggagagggaggagcgggtgccaccttggcagtgtcgtgagtttcagctggagtccgccagccctctgcttcactgtcataggcagtggtcgccatgtgggaaggggcaaaaagaagccgaagctcagagaggaacaatggatctgtgtgtgattgatctacccatggccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatctctgatgttaatgggctctgccctcatccccacagtctcgggatctcagggcacaacggatggacacgagtgggctctgatgcagaactttctcttttgaatgttaagaataactaatacaattcattgtgaacagaagtccttacgcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccaccccacccctaagtacggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttggacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgactcatgctgctgtttatggtcctgtttagtggggaatggacttagattacccatttcccagagggaaggatcccaggatttttgaaggttacatattttctgtaccaaatataatttcattgacatgaatta

SEQ ID NO: 461436 - DNA, 2185 bp, Homo sapiens
  misc_feature (95)..(95): n is a, c, g, or t
  misc_feature (104)..(104): n is a, c, g, or t
gcatgtgcatgctgcaatgcatgctgagtagactcatgaggatccctccatactggaccgacagccctctgtactgacggtaaccctcgtgccgncttcgtatnacctcaatgcacaccttaagttacaacgcattcctgacgctgtcatctttgatgaatgcgccctgatcgagccacttacatgtggggttccatgcctgcaagagaggcagatttaccctgtcacacaacgtcctcgtatgtggagcatcgccaatcgtcatggtcacttcgttcgtgcgcgaaggcaatgcggacgcagctcaagtatctgtgtgcatctgatctgtctgctacccgattgtccaaagccaaggagattggggctgatttagtcctccagatctccaaggagagccctcaggaaatcgccaggaaagtagaaggtctgctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatctctgatgttaatgggctctgccctcatccccacagtctcgggatctcagggcacaacggatggacacgagtgggctctgatgcagaactttctcttttgaatgttaagaataactaatacaattcattgtgaacagaagtccttacgcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccaccccacccctaagtacggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttggacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgaaaaaaaacccaccattaaaataagacaagttcatagaaatcattccaacagaaagataccaagagcctttactggtaatgtcgga

SEQ ID NO: 461437 - DNA, 1845 bp, Homo sapiens
ggttgagcagttcagcagtttatacaaatcacattctcaggaatttttggatgctcagctgatgcaaccagaagatacttgtgtgatgacaatatgttattgtaagtgggaagtcagtatttcttatcttctgagctttcttgtttttacctcctttacaggccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatctctgatgttaatgggctctgccctcatccccacagtctcgggatctcagggcacaacggatggacacgagtgggctctgatgcagaactttctcttttgaatgttaagaataactaatacaattcattgtgaacagaagtccttacgcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccaccccacccctaagtacggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttggacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgaaaaaaaacccaccattaaaataagacaagttcatagaaatcattccaacagaaagataccaagagcctttactggtaatgtcgga

SEQ ID NO: 461438 - DNA, 1254 bp, Homo sapiens
ggaacttcagggtgttggtaccgggaatcccggccgcgtccacgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccaccccacccctaagtacggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttggacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgaaaaaaaacccaccattaaaataagacaagttcatagaaatcattccaacagaaagataccaagagcctttactggtaatgtcgga

SEQ ID NO: 461439 - DNA, 703 bp, Homo sapiens
ctaggttttgtggacagaaacaaagtgtttgggagagattatggccagtggtcaagcgcgccccccgtttgaggaggagagcccccagcctagcacaacggtacggtcccccgaggtggtggtggatgatgaagtgccaggaccatcagacgaatccgaggaggagctggaggaggagctggagttggagcgcgcccctgagcccgaggacacctgggtggtggagacgctgtgtgggctcaagatgaagctgaagcgaaagcgagcatcctccgtgctccctgagcaccacgaggccttcaacaggctccttggggatcctgtcgttcaaaaattcctggcctgggacaaagacctgagggtgtcagacaagtatctcctggctatggtcatagcgtattttagccgtgccggcctcttctcgtggcaataccaacgcattcatttcttcctggctctgtgagtagtttgcttcttcccatctgtcaatatccaacaccctgggacagtggacgaagtgggattccaaccttccatctatttttttaccctacttctcctctttactctgtatataaaaacgataagattatactatggtgttcttagtctgttctttctaaaaacaaacacaaatgcagttgacaaatagtagaatcaaacaaaaggaaacataaacccgtcctaaggggaaaggaaagcc

SEQ ID NO: 461440 - DNA, 710 bp, Homo sapiens
gagttagtgggtgcagcacaccagcatggcacatgtatatgtatggctgctccctgttctaccacatgtcctgcaaacgtctactccactgagcacaacgcattttgaatgtgtagtcactcatctgtctctaccaccagaagtctggttcagagcctggtacacaaaaagtgccctgtggatatttgtgtcaatcaatccatgggcccagggtgacttacttgtaggacaaagcaaggagctcctgctttgggacctgaatttatcacctctgccaaatctgggacttcacactgctgggaagaagggacagcttagaagagcgtgctctgtgatccctcctctggatgctgctcctgactctccccctccatcgtcctctgcccacaggcccatgctagcctccggcatcttccagttacttagaatccatgtcagcaaatgcgtgcagactatggaggggtccacagaagagctgagcctcctcctagcagccaacaccagcttgccggcgatgtgagcggctgccttggaagtggaccccctgccccagcccagccttcagatgatgcagtgccagctgacagcccaactacaaccccatgggagaccctgagctagagggttccagccaagccacatgtggatcctgacccagaggaagtatgtaagataataaatggttgttttaagctgctgaattttggggt

SEQ ID NO: 461441 - DNA, 1061 bp, Homo sapiens
ggcgtcagtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataatatgggattagatgattccctttttttgcatctagtttttaaaaagggggtatttgggcagctattgttttttattttaatctcttcttgtttaccagagcacgtaagttagttgcaccagcagctatttttaaaagtttccttttcc

SEQ ID NO: 461442 - DNA, 915 bp, Homo sapiens
ggcgtcagtcgaggagtcaaggcagcaatgaatcgtgtcttgtgtgccccggcggccggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataata

SEQ ID NO: 461443 - DNA, 994 bp, Homo sapiens
ggcgtcagtcgaggagtcaaggcagcaatgaatcgtgtcttgtgtgccccggcggccgggtgagctcctcaaggtctcggagggccgagggcagacaccggcgggcgggcggagcgcttactgctctctctcttccagggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataata

SEQ ID NO: 461444 - DNA, 922 bp, Homo sapiens
aggctagtcgggctgggtgtgactcggcaccgaggaatgaatcgtgtcttgtgtgcccggcggcggggccgtccgggcgctgaggctcataggctgggcttcccgaagccttcatccgttgcccggttcccgggatcgggcccaccctgccgccgaggaagaggacgaccctgaccgccccattgagttttcctccagcaaagccaaccctcaccgctggtcggtgggccataccatgggaaagggacatcagcggccctggtggaaggtgctgcccctcagctgcttcctcgtggcgctgatcatctggtgctacctgagggaggagagcgaggcggaccagtggttgagacaggtgtggggagaggtgccagagcccagtgatcgttctgaggagcctgagactccagctgcctacagagcgagaacttgacggggtgcccgctggggctggcaggaagggagccgacagccgcccttcggatttgatgtcacgtttgcccgtgactgtcctggctatgcgtgcgtcctcagcactgaaggacttggctggtggatggggcacttggctatgctgattcgcgtgaaggcggagcagaatctcagcagatcggaaactgctcctcgcctggctcttgatgtccaaggattccatcggcaagacttctcagatccttggggaaggtttcagttgcactgtatgctgttggatttgccaagtctttgtataacataatcatgtttccaaagcacttctggtgacacttgtcatccagtgttagtttgcaggtaatttgctttctgagatagaatatctggcagaagtgtgaaactgtattgcatgctgcggcctgtgcaaggaacacttccacatgtgagttttacacaacaacaaatgaaaataaattttaattttataata

SEQ ID NO: 461445 - DNA, 1340 bp, Homo sapiens
tacttgtggttaagttggtcttgtgcagcttttttttttcaaggggtttgagatttgtctatgtttgtgaggttggtaaagcagactcagtgtctgggtgtgtccctgaagacagctatttatgacaagaacaaccaaaataacgaaggaatttcacatcgcaaatccctaagaatttccgatgggcaagacaagggcatctttgcaattgtgtgtaaggagcaagttctggatgggctgttagattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagactggaaagggattaaatgcacagggatatgcacccctgagtgtgatgacagggaaagatagtatgttgttctctgagatggaaccttctggacttctcaggaaaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggttggcttgggaaccctactcttttttccttacaatttcaagcatattcattaaaatttataaattttaaggctattacatgtttattgtcaaaagttcaaataacatagaagtgtataaattctacttccatatatttcccccatccatcttcccagggagctttcagtgtaatcagggaaaacttgtacctttgaaacaatttgaaaaaatataaagcaacatataagaaagtggcatatggaatatactaaagtgtccaagtgtactgataagtattcctgtggggagagttttatgacttgttcccatagcacagtgcacttcacctctcataattacatttctggggttaacatctgtctttctcactaatctgaaaacat

SEQ ID NO: 461446 - DNA, 3185 bp, Homo sapiens
tgccacatttcttttaatttttgagacagaggttccgggttacctagaggggaggccgggcaggagcagcaggagcagcaggagcagcaggagcagcagcaggagcagcaggagcagcagcaggagcagcagagactctctctgcccagactctggccagggtgggggccctggaactctggctttatccctggccggcgcctcccggccaatcccagctgaggctgcctgtgtgtcacaatggggcgcctgtggcgtcacgctggcccgccccaccccgtgtgctcgtctggaaccgcccgtcctacttgctgccccatcgcgagagtccttcctctccagttcggtccaccacctgcccccatgctcgatcctctgtggaaccaggagctgtcccacaccttatagaggcatacctgggatgacggacaatgacttgcccgggatcactttgccaattggaaaggaggaaaagtcccacacccgtggcgctgtctccggagggtgctgcgtccaagaggcccacccgcagggatgagcctgagtgcgcgaatccaagcacgagaagggagctgggaatctcccggtggctggggacccctgctccttctagagcctctgcctctaggtctttaataaagtatatacaatgtggctacagctggcatatgcctttaaatcctttcgacaaacactgctgggaaggtggttccaatgctgaaagttctgagggcgatgaaacaaaggcaagcctctgagtcagtccctctggttgctgccagactggtcgaaaaatacaaccacagctttttgagaacaaggaccttattggcctctctggcacaagcaagctgcccaaggaatgtgggccaccatctccatagctgctttctgaactggggattgagaggtggcgatcacagggcacgccctaagaaacctgcacactaacctccctctcagacactgcttctggagagcccaacctgtgaccgctgggtcaggaggggtctgaggaagaagatgctaagatgggattctggctctggatcacccactgcctagctgctgataaggatccttttgctgggggtagatggagcgggtacatgcccccgcacagagcagagtgccacctgcccagaaccgctccacggtccatggagatcggtttacttctcttttcgcctgcttccgcagccaagactcaactccctcccatccatgagttctcttggagtatctttgtgtaaacaaggtctcagtaactaaatcctgtttccatctccctgcatcagtgttctctggctgggtgggcggagctcctttggctcggtcctgctgatgtccttaaaggcctcagcccgtggagtcaaagcctggggccagcggctgcaggattctaaacactgtgagtgctcagttgcgcagctgggtgtgggactgtgtgacggcaagaagcatccaaaggtggacgtggccagggatgggaggagccatcggagaggtggtaaggacagcgaccgagttccccgagagaggcgagtcttagtaattcgggaattcagcccccacgactgtggaccaatggcatataaccagatccccacatactcaacttccacagtcagccctgccaaacctccttgcaggaaaagtcaacactctgtaaatgtgggctttgcatcccatgaatactgtatttttcatcctcattcggttgaaaaagagctgcgtgggaagttctgtcaaccctggcctgctttgggacaccagtggacctccccagagctggtggtgaaaattcctggagatagatcctccgaatgaggaacaatgtattcttcttttctcctaattctcctaaaaaatccacttgggagatacctgctgcaaaacttaaaggcaaccatattctgtacttagatgaagtgtttgtcaagctccctggaaaagagaatcaaaggaccctgacttgtttactctgccttctggaagaaaaaagtgatgagagagagtggcaatctcacaccatgctgaaaagcgccccccaactaactcagatccatgcgtccctttgggccctgaggaataatactgctggtttaattcaagatataaaaccaataaaaatggtttacctaaaggatatgccacaatggccgtatgtgaaacaatatcctttgtcctgagctcggtttgagagaatcaaacccattataaaagaattagaaaaacaagggatacttctataaaaggtagcctcaccttgtcatactcccatacttccagtaagcaaggaaagtaaatttggtaaagatggttgaccattgtgtagatttgtacaagatctttgagaagtaaatgaatttgtagttcctaatcctgcaactattttgactttgtttctgttgtctgtaatgtgttctgctttttcttcctgttcctgtccaaacccttgtttgcttttacctacaaaggagttcaatacttaacttagtaaagaatttctcaaggatttcaggactctcctactcttttctctagcaatttacaggaaatattagggaaatttgtcccaccagagaaatttataattatccttatttctttatagcagagtaagaacagcctaacacaaatggtaataaaagaagacactgggctccaatgtgatttatctgacttttctgttaaaaattcagctttgacctgttaaataaaatttataggatgcaattagtctggagtgagcttctgcactaggccgaacagaccaaaccaaaatagggttcttcatgctgaagttccacaccaacaagccaaaactaaattgtttatctgaccttccagggaatcaggacacacagggataatagccaaatccccaaacaggccagttttagccagcatgataggacatcccctctgctttaaactttgcagatgctcccaataaacccatcctaaattaaaaatattacaaattaagtcattttaagttggggaccatcatacaaggaaagtcactttgaaaccactcatctgctttttgttctctgtttctgctttccacagcccttttctgcctatcaagccaaacctcctcgttcagctcatcggaacactcattctgttttacaagaatgagttattgcccaattcttgagtcacaaataaaagcc

SEQ ID NO: 461447 - DNA, 2720 bp, Homo sapiens
  misc_feature (2)..(2): n is a, c, g, or t
  misc_feature (6)..(7): n is a, c, g, or t
gntccnntagattactgcatcttcgtcccctacacttagccacaaaccgccaggcaggtgcccaagcaccgcccgcgctgcgcgggtcccgagccgttctcgacatcggtggcagcctcagccgcgctcacctgcatctccccggaacgcccaccagagggcgctgttggacagcgcgcagagccaagcttatggggcggaagagctgcgaggtcagcaccgccgactggagcactcggggcgggtgggcaggacgagcggaggccgtgggttggagcgtgggagaccttcaggagctcctacgtcctctaagaggcttggcgtagtccggcgaggtctcgggggtgcgcggacaccagcctcctcagcctcaggtctggaatccggcgggatgggggactgggcgacggcattgtgagggctcggcggaggcgccagggggcgctagctggctcctcgcagccgatccaggccgcggcggttccacgaggtccggcgccccgcgccccgcgacccgcggtcctggccaagctgtcagggaaggtgcggcggagaccacccgttcctcttctccctccctccctccctcttcggccggcggggagtggcgcccaccatccagcctgcgcctctgcgccctgcacccccatccgcaccctttctccggccaagtttccctgcgcccccgttcctggtacccgcgccggcctccgtggctcctccacggctctctcctggaattaagcttccgggaagggtttggccgattctcagactggagaaggcgggccccagcagaggcccgagtgatttcgagaagccccgtggctgggcgtcgatgttcgccctggactcagtgacccagtaaccccacagcaggaggaacaggctcgctacggggttagggaaccttcaggcgccgagaaaaagatacgcaacggcaagccatacttttctggacactggctctgggggcgctgctcctctgaacctcgactttccccaggcacgcacctcagagctgagccccctggggactcccaagctctgcgtctccctgagtcctgaggcaggagaggaggaggcttcaggggcggactgagcctcctccccctagccgtaccctgtcaccctgggagcctggaacgtgcatctgaggccagagcgactcttgcctcttttccagtgagctgggggaaagtcaccctcctgaggagaccagccttcgagggcgtcatgagcgcgtgtttggggcaggaaccggccggccctccctgctgtgctaccccctgaaactggatggcccccctttcattcccccagctcaggagaggcttgaccctactggaagctcgagggcgcaggcctggaggaaagagaggaacagaaatccgggctgtgggggagcagctggaaagctggagaagctggaggaaggatgttgctggctgttcttcccccacccccattcctgagtttggggctgcagcccccacaaaatctgccctgcaggtccaagtagtacccagcagccaagcagtagaatttgggcagcaccccggaagaggcttgcaggataggacacagcccacaagaatcatccgaggctgcaccgtgaccagcccctcaagacagagcgagacccaaataacccccgcgggcggacccgcagcgttctgtgactccaccgcggagtccaaaaggcagctgagggtgggagcggaggggaagggaggggggccacaggcgctcgggcgagggaggcgcgtcaatgggccgcaggggccggatcggtggcctaatggattcaggcctgcacggcagaggcgcacccggcggcctgcccgcgctctcaatagcggacaatggagtcccggggtgacctgaacaaagaatttggaagtagttaaactgcagaacacgttctcggcctgggtgcctcctttcaaaaggagcgctgggagaagaaaagaaagcactggggggtgaagggagtgagaaaatgcccaggggaaaagttggtaggtcgccctagttgccgccagctaccagacgccaggaattcaataggaaatgggggagggggtggcccaagtctaccagaccgcaaggagaatcagataaagttctccaggagatggctggggttccggagcagaactgagctttcgcccagggcagagagcacctccccccacaacacacacacgcacacatacacacacacggtcaaggccaggagaagcttccctagggctttggagctagaacaggaaccagtgagtggagggggtgtctgggcccctgtgtctagccctacatggcgctgcttccctccttggctcctctaacaggaggatagggctccctctttgagccctttcgcagagcttttgtttttccttccccatccagttcagaaagactgggttctctctctccaccccttcttcactccccaccccgcacaaccagcaatctaggttcttctatgagaatatatagtttgtattttaaagtcaggcctctaggtgtaaaatatagggccaattattattttatttcattttttcaaaattttctaatgtttccacaatgaacacagccacaacgtaggaaaagaagacatttaaaaggcagtcagttatactggtatcaaactaacttagaagagaaggaacttgaaagactgtggaaaccaaaagtgtaaataaaatgac

SEQ ID NO: 461448 - DNA, 1119 bp, Homo sapiens
accacaacaaacctacaacatatgtacttggctttccagatttctcataacatagctctgccctgcctattcgtaagcatttcccaatatttccccaaacccactggggccacttgggcttggcaggctatggtgacaatgtatccacaatcacgtcagaagtctacggctaaatttagcagaacaattgtcagccagcttccctgtttgaaggtgagagctcacggggacagcaagctcccagcgggtcttcatttactgcttcatgacaagaggttccatgctgacagcatctggggaaacctcgctgggcctcggaggtccttcctatgggtgatatgccacccaccctgggtcgagagtcagagaagcgcggccggtcccactgctggcttcgcctgcctgtttcccacagcttccctctagtcatccacctacacctgctgcccagttccctagaaacctgcctagtgtaaaaggaagcaactctggagaacagaatgagaaatcagaaagcaaggccctgtcctctgagttctgtcctggatggggactgaggaagttttatgtggtccagagaggctgcatcagtctcaggcccctaagccttgcctggttcaacagtattatttcactcacgctggtcaccccattgttagaaagagcaaggaaaggaggatgagaaaggaagagagggagggagaaaattgtccccaagaaaaggaaactattgtctggtaagattcagcccacttttcttgttaaatgatgtgaattcaaattgttgatatatatcaccaacttgacatgtgaaactattgtctcaaagcatattataaaatactatatatgaaaacattgacaaatatactgtagttgatgagtaccagatatgattattgttcttttcatgtgtgattacaggtgatggacagatggtttcctcaatttatataatttaagatacagatcattcccaatacaacttagaatctcattagtcagtacaattttctgaagattttgcccatttctgtctcatactgctgataggcaactgagaggccctgaagacagggtgttctaaaaaaaaaagttgttcttcccccaaatctatga

SEQ ID NO: 461449 - DNA, 3069 bp, Homo sapiens
caactcagcagtctataatccaactcgccttctccacaatgccaaaaggggcaaattttggaattattttaaaatcagtctgatgcctcacacatcacggctgctaaacttgggtatttgtttttcagtgcaatgagcttcatgctgaatactgatttgaagtgtggttcaccacacagacttaaattgtccttcccacaactttatctgagaagcatgacaacggtgacaatcacaggactagttttattggtcaggatgtggtgttactatattaaagcgcttcaagttttcatagcgctcgtcaaacagagacctcggaacgctctgcagacattaattaatgttcgctccggccctggaagccatttcaccaatggaaattccgatgagaaaggaagaaacgaggggttcaaggccgcgccgttgtgagtccgctgcggaactaggaactgaaaccccgtggttcccaatgagccagcgaaagtctgtcgaagtattgagcacccctattgaagactgtgggagttttggcggcttaatgggattgtgttcggtccttcaggctctcctttaaaagattccatggcaccaacgagactccaataaaagggcctctctaattgctttctgactttctatgaaactttctaagctatgctgacatcctcgaatacaactatggaattaaagaggagagaaaggcgaggcacagtgggtgcgcaaagaaaaagaggttctcagcggagcgtgtgtgaggcggggggttacgggggaggggagacggggcgggtgtgaagtctgtgccgggaaaagaaaaatatgagtgttctcttttgtgtgcgcacaaacagccgagcgcggggaggtcgggcccggggtcacgcggctccgggctgcagctgccgccgtggggcggggggtcccaggcggccaccgggcgtcgcggccgcctgcggcatcagcattccggcggcgcgggcggccgctgtcctcgcgcgaccccagcccgtccagagcgcgccccggcaccgaccctcggggcgaggcgagcgcagcccccgctggccaacaaggtaagcgcggcgcggggagcggtggccgggagcctgggcgccaggcgacccctcgacagggcgcacggaccggttctccgccgcgcgggtcgatgaccgacggggaggcccgagtctggccccgacgccctggcccggtgtccccgacgcgcctggagcccgggagggaggcgcgggcctggcctgggcccaggaggatggagcccgactcagggccgtctctccccgcttgggggtgctcaggagggcccagggtacctgcgcgggcaccttggcggcgggtcaccctccctccgagccactccgtccgtgggcagcggccttaccaggtccgagccggacgctcagcgttgccctccgcgagcccccagcctcccctcgagcgccgcgggagccccaggtgcacacacgcaggcctgggccgggcctccaggcctctgtccttcgggcgggctgggaggtggcctggcgatgcccgccgaggggtggagagggcgaagccagggcggcgtcggcgaggccatcaaaggccgggggtggcggcccgccgcgttgcccatgaccaggccgagggcatgaaaggatctttatcctccagtgacattgccaggccggcgcttttctgcggcctccccctcccgcggccctaattggggccggctgctaatgtgattaaaggccagttaaacgtttctccgagcagggggtgggaagaggccgagacccctgccccctccccagggtcacgccaggcccgtggtcgggggtcggcgacggtgccagcctgggacggcctggccaggtgcctgccgattgttcacccccaggcgggcgggccggcgggctcccggggctttatgtaagccggtgggctttgggcccgaccggatttagggattcttttcgcacagtttccattttctggcctttggaactgcgccctaagccctcggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgccccccgcggcctcggcgacagcccggttcccacgtcggcgacggcgtgggtggtcccgcccgcccgggagggctccgagtcttggccgcccggggcgcggggcctgagagcgagtgtctgcgccgcgctgcccgccgcgccagtttccgaggtcgcccgcgggctcatgccctgcgccctggggccccggggaccttctccaagccggcctgacctggtggaggctgtgcgctgcgctcggggaaggccgggctggtgccgggggcagcgggtcccagctctgaagtgccagcgccggcgccccactccccgcctgctacggtgctctcgcccggaaaggcccgaggccctggaaggagccccgcgggggggcgccgtctggagcagccctcaggggcgccgggctgccgcgacgcagtggctgtaattgcttcggggtacctggggatcgatggcgtggcccagccgggtgtctgcgcctctgaggttgcaaatctggaaccagttaggatgcgggaggcagataataaaaagccaaatgggcgccaggtggaggagtgagctccgcacgttccatcaggtggcccgggccgcgcgctcgggcggcggcagagtctctggggcactcggggcgggcggcagcaggtgggacccgcggcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcgg

SEQ ID NO: 461450 - DNA, 872 bp, Homo sapiens
agaaggaatgtatgagtgaaaaagaagcaatttgtaaatttactctcttgccttcgtggggatcttcaaattgtttaccctgcttttattccctctgtggtgctgccacgggtgcgcgggctgagcaggccgcccttctccccacttggagaactctgaaacctgagggcctctgccggaagctgctgttcggcccatccgggttcccagaggagccacttttcctcctactagcccggggattgcaaagtatctggatccttaaattctctatcccatatgcccaagacttaagagccagacccagatgtggggcccaactgggggaaagtaggggaacccagggtacagctggggcccacccgaccaatgctggcaggcaccacagacacctcggtccacctttccaatattttgctcaatgtttggggtacccaaggggcagcgtgcccgcatgttgatgcaagtgtgacccctgtggctggaacgccggacagggctttcctaaggccctgcattccgcgcactgacttttcctatcaatgggagagacgcaggctattgacccaacggcctcctcctcgccgcctattgtcgcggctcaatcgcgcacttaccggaagaaaagcgagtttatcttagcttggaggagcctcgtgttgcgagtgtgtgtgtgtgtgtgtgtgtgtgtgtgtgtgtgtgtgtgtgtctcaagggtgaggggaattctgcaaccagaactgcgcagatgggttgtggatagacaatttcagaaaagggccaatttccccttcacaatgagcgctaagtacctgataaatggggttggtgtttattcatgagcaggtacttggagacggcgattagaacag

SEQ ID NO: 461451 - DNA, 1632 bp, Homo sapiens
ccaaatctgcctcgatctccccaggaacctcacagcaaatgaaaagtatgaaatgttcttgaatcaagccaggaaaaacacagacaaagagtataacaaatgtgaaatgctcgatcactttgacgtaataactgaggaagtgccagaagacgagcctgctgaggtaagtgctcatctccagatggaggtagaaagacttatagtccaaagctatgtcctagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctgcctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagcagatcttgcggaagctgaagggctatgattcctacaacaccctgctgctgcctccccacaaccctggggagaagctgcccccagaactgtacgagtacttcaaagagataaagaagtcaaaagaggagcagatgagggcgaaatatctggagaatctggcacaggagaatgaaactggtgccctaaaagcagggggtgggcattcacacaagcagaagacgagcccctccatagtcctcaggccaaactccaatcgcagagctgtcctgtgctctcagaattgtgccctttctggcccaccacccctgagttatcccatcatctgcccaggggctcttgtgtgcttggccataaaggttcctcgctgacttgtgggactgtgtcacttatgaggatgcatcttctctttcctgcttctctgtaacctcatcctagaaatgtacccaccttgtttttacttgctttcatctgtgtaacagtcatacac

SEQ ID NO: 461452 - DNA, 1726 bp, Homo sapiens
cctgaattcaaacctacgagccccactccgaagcaggagctgagggtctgtgtttgcgacatcattcatatttttctgaccttcctgattctgctctccttccaacccccactccccaccctggtacagcaaatgaaaagtatgaaatgttcttgaatcaagccaggaaaaacacagacaaagagtataacaaatgtgaaatgctcgatcactttgacgtaataactgaggaagtgccagaagacgagcctgctgaggtaagtgctcatctccagatggaggtagaaagacttatagtccaaagctatgtcctagaacatcagaaaacaaccacccctgatcctatggatgacccctgcttcagccatcggagtcgccgcaaactggccaaaatccagctaccagagtacatcctggactttggctacatcatccttggcgaagtccgaacccacatcatcaagatcatcaacaccagtcactttccagtgtcattccatgcagacaagcgtgtccttcatgagacaggattcagtactgagctagatcgtgtaaagaatctgcctcattgtgaaacggaaatatttgaagtgagatttgacccacagggggccaatcttcctgttggaagcaaagaagtcattctgcccatcaaggtggttggagggccaacagttcacatctgtctccaagccaaggtgaccattccaaccatgactctctctcgtggaaaagtggactttgccacaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagcagatcttgcggaagctgaagggctatgattcctacaacaccctgctgctgcctccccacaaccctggggagaagctgcccccagaactgtacgagtacttcaaagagataaagaagtcaaaagaggagcagatgagggcgaaatatctggagaatctggcacaggagaatgaaactggtgccctaaaagcagggggtgggcattcacacaagcagaagacgagcccctccatagtcctcaggccaaactccaatcgcagagctgtcctgtgctctcagaattgtgccctttctggcccaccacccctgagttatcccatcatctgcccaggggctcttgtgtgcttggccataaaggttcctcgctgacttgtgggactgtgtcacttatgaggatgcatcttctctttcctgcttctctgtaacctcatcctagaaatgtacccaccttgtttttacttgctttcatctgtgtaacagtcatacac

SEQ ID NO: 461453 - DNA, 1026 bp, Homo sapiens
cgggaatttgtcactgaaatggtgacaggagcctacaggtggcagatgagaactctcaacacagttgtgttagaagaaggatttcctagagagaccctgactcaatgatgatacatggctgaagcattgcatggaaaacgtcgtgggacccagtactctactcgctgctatcaagaacttggatattttagatcctacatgcagatgacatcgtgaagcatttgtctttcggcatctggcttattccacttagcaccatgtcctctagctccatccgtgttgttgcaaatgtcagaatttcctttttttttttgaaagccaaatgaaattcagtttatatatatacattttctttatacagtcatcaatctatggtcattaaattctttcacaaatctacactattataaataatcttgcaattaacatgtatttgacatcataattttatttcctttgacgatataacaagaagtgggatcaccaggtcatatgatagctttatttttcaatttattgactaaccaatcttaccatacgatataaggataccctcttcaccacattcttgccaacatttgttatcttttgtcttgctgataataaccattttaagtggtgtgaggtgatatctcattgggctttttatttgaattcccctgataattaggaatgttgagtacctttttaggatctgtttttcatctgtgggtcttctgaaaaaaaatctaaccaggtttttgccctctgtattaggtcagttgatatttgctgttgagttgtatggttaatttatatatttgggtggaacttcttgttagatatataattgcacatagttttttttactgtgcttgcttttggtattaaattcaaataatttctgaatcaatgacgaatatttttccatgttgtctatgatttatggtttcaggttatgttcatttttagttgatttttgtatatggtgttagagaaggtctagtttcatttcattttttttttgcacatgcatgaccattttct

SEQ ID NO: 461454 - DNA, 2024 bp, Homo sapiens
  misc_feature (5)..(5): n is a, c, g, or t
  misc_feature (7)..(8): n is a, c, g, or t
  misc_feature (10)..(10): n is a, c, g, or t
  misc_feature (14)..(15): n is a, c, g, or t
gtgtnannantcanngaagtagatggagaatacaactcaagtgtccatcgactgccagagggatgaagacgccgcggtgcgtctgtaacccacagggatgaagacgccgcggtgcgtctgtgcatctgtaacccacagggatgaagacgccgcggtgcgtctgtaacccacagggatgaagacgccgcggtgcgtctgtaacccacagggatgaagacgctgtggtgctttaaaaaggagtgaagcactgacataggctgcaactcggatgggccttgtaaacattggactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatacacaggacccagtgactcccagcagtggctctgctcagatcagcgcagagcttgttcgtctcctgagagtggagcacaggacgtggctccaacaccagccatggcatggaagacagagagcagccctgggtgcctgggtcaggtgcattgtgctccctgcaggtggagggagggaagtgctgactcagggcccagagactgtgggttctatacagaacatacacttttacttcatttctgtggatgacatagaaacaaacatgcagtctgtaaacaatggtgattcctacatttgccccaattgctttattccttaattctgcagaatgtcctggcacagaattgcctttctcatgtggaattgtgtcgtgtgttgtggatgtggcttcactccttgtgccttttgtctttacttattttaaattgtatcatttttctgtaataaactgttcctgtgaatagaacagttatgagtcctgtgtttttactgatttttcagcctacaggtggcagatgagaactctcaacacagttgtgttagaagaaggatttcctagagagaccctgactcaatgatgatacatggctgaagcattgcatggaaaacgtcgtgggacccagtactctactcgctgctatcaagaacttggatattttagatcctacatgcagatgacatcgtgaagcatttgtctttcggcatctggcttattccacttagcaccatgtcctctagctccatccgtgttgttgcaaatgtcagaatttcctttttttttttgaaagccaaatgaaattcagtttatatatatacattttctttatacagtcatcaatctatggtcattaaattctttcacaaatctacactattataaataatcttgcaattaacatgtatttgacatcataattttatttcctttgacgatataacaagaagtgggatcaccaggtcatatgatagctttatttttcaatttattgactaaccaatcttaccatacgatataaggataccctcttcaccacattcttgccaacatttgttatcttttgtcttgctgataataaccattttaagtggtgtgaggtgatatctcattgggctttttatttgaattcccctgataattaggaatgttgagtacctttttaggatctgtttttcatctgtgggtcttctgaaaaaaaatctaaccaggtttttgccctctgtattaggtcagttgatatttgctgttgagttgtatggttaatttatatatttgggtggaacttcttgttagatatataattgcacatagttttttttactgtgcttgcttttggtattaaattcaaataatttctgaatcaatgacgaatatttttccatgttgtctatgatttatggtttcaggttatgttcatttttagttgatttttgtatatggtgttagagaaggtctagtttcatttcattttttttttgcacatgcatgaccattttct

SEQ ID NO: 461455 - DNA, 881 bp, Homo sapiens
aatgagggctttgccctcaggctggctgttctcatgatcataaggtactaattagagaagtttcagatgccacatccagacatactttgtagaggaataaaaaaggtgacacaagtgtctccagggtacctgaagaggctgattgtgcaagtgttgaaaaacccgtggactgaattcagccagctgctgcctcagggaaagaactgctgctgccagggtgaagaagcgtatcttatccagacagtgaaccaatccaaaacacaagcagatacacagaaccccacagcgggaggggatggaggcaatccaggaggtcaacatggagaggagtggtttccagtggagggtaggaagatggttaaagctcaacctaggagaaggctgggcagctcagccaaggtggtcatttgcgtggttccaatcagataaaggagcacagaagaactctcagggaggcacactgagctacgtggtcagcctccaatctcctttgagcaagagatggccaagtttggaatgagtttagcaacatgaatcctacacgagctaggagtgaatccagaagcagagaggagggtcactcttggacacaggacctcaaattatcctgttcaaatgacccaagggagtacagaaacaccttggagggtctcctaaattcacctgttcatagatacaaaacgcttatcactgaaacatactctaaaccactagctgttaattcctcaggacataataaattttttttaattgtgcttgtggatttcaaactaaccaaattggttgacagaactgttctacctttgatgtcaattcagttccccaactactgtttgaaatggttaaaataaaaacaacaacaaaaataataaagagtcctt

SEQ ID NO: 461456 - DNA, 457 bp, Homo sapiens
aattcaattttcaagggaagtggtacaggttaagccagatggttagaaaaattgctttcattgttatcttgggaattttcctcctccaacagatggttaaagctcaacctaggagaaggctgggcagctcagccaaggtggtcatttgcgtggttccaatcagataaaggagcacagaagaactctcagggaggcacactgagctacgtggtcagcctccaatctcctttgagcaaggtgagtgctgtcctgacccactttaaagccagctcattagatatattcccattcaaatctaagtctaagttcatgtctgtctctcatcagtctgtttcatctctctctctcatacacacacacacacacacacatctacccctaaagatgttccatgtctctttctcttcctttccatagaaaactgaggcctgattacagtggtattagtcagttacat

SEQ ID NO: 461457 - DNA, 3124 bp, Homo sapiens
acccaattgtggccagacctattaatcctgactaaagcagatataagaggtaatgaatacaagaggaatgaaagcctcaagctcagattctttcctccgctgtgtccagtctatgggtaagcccatgaagggcaacactggaggacactgctgttttatacagttggacaagaatgtcgtagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagaatgatacctcctacgagcaaaacttttctggtcaataatctggctgctggaactatgtatgacttgtgtgtcttggccatatatgatgatggcatcacttccctcactgccacaagagtcgtgggttgcatccagtttactacggaacaggattatgtgcgttgccatttcatgcagtctcagtttttgggaggcaccatgattattattattggtggaatcattgtagcatctgtgctggtattcatcattattctgatgatccggtataaggtttgcaacaataatgggcaacacaaggtcaccaaggttagcaatgtttattcccaaactaacggggctcaaatacaaggctgtagtgtaacgctgccccagtccgtgtccaaacaagctgtgggacacgaagagaatgcccagtgttgtaaagctaccagtgacaatgtgattcaatcttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactcaactgccttgcagttagctagccgtcctcccgattctgtcacagaggggcccacgtctaaaagagcacatataaagccaaatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaatttgcacattgcctgatttgtgaaagtacccattgcttcaagtgtgagtggtgaaataattattgcaagaacaaatactactcttttacatgtaggccgtgcaaaaaccttaagagattacaagcggctttataatattggaaatatttcttccatgattcagtgcacccagttctttgggagagcagtacagctatttaagcaagtttatactaattttatgcctcagtataggatagaaagtgataaaggctctcttctcctagtaaaacttccaaaatgatcaagataggaatattataatgaatccaaattgattcattgcttttctagggagccggggcaaaagaggttttaataattacaagccttaagtgcacatttctccaattttgcacaagttcagagtaagaacaaagaatatgcatctgctttactaccagcatac

SEQ ID NO: 461458 - DNA, 2064 bp, Homo sapiens
  misc_feature (2040)..(2040): n is a, c, g, or t
acccaattgtggccagacctattaatcctgactaaagcagatataagaggtaatgaatacaagaggaatgaaagcctcaagctcagattctttcctccgctgtgtccagtctatgggtaagcccatgaagggcaacactggaggacactgctgttttatacagttggacaagaatgtcgtagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagaatgatacctcctacgagcaaaacttttctggtcaataatctggctgctggaactatgtatgacttgtgtgtcttggccatatatgatgatggcatcacttccctcactgccacaagagtcgtgggttgcatccagtttactacggaacaggattatgtgcgttgccatttcatgcagtctcagtttttgggaggcaccatgattattattattggtggaatcattgtagcatctgtgctggtattcatcattattctgatgatccggtataaggtttgcaacaataatgggcaacacaaggtcaccaaggttagcaatgtttattcccaaactaacggggctcaaatacaaggctgtagtgtaacgctgccccagtccgtgtccaaacaagctgtgggacacgaagagaatgcccagtgttgtaaagctaccagtgacaatgtgattcaatcttcagaaacttgttcgagtcaggactctacatacctgttgctctccggctcagatctggnccaagagaagagctgaaagcagca

SEQ ID NO: 461459 - DNA, 3366 bp, Homo sapiens
ggagaagaggccaggcttttgcatcttagagaacattaagcagggagcgcttggagtcttctttgggtccccaccttgagctagacgtgaagttgacccctgggctgcagcatggctgtcgccctcgactctcagatcgacgcgcccctggaggttgagggatgcctaataatgaaggtggaaaaggaccctgagtgggcatcagagcccattctggaaggatcggatagctctgagaccttccgcaaatgcttcaggcaattctgttatgaggatgtgactggaccccatgaagctttcagtaaactctgggaactttgctgccggtggctgaagccagaaatgcgttccaaggagcaaatacttgagctgctggtgattgagcagtttctcaccattttacccgagaagattcaggcttgggcacagaagcagtgtccgcaaagtggagaggaagcggtggccctggtagtgcatttggagaaagagactggaagactaagacagcaggtcagcagtcccgtgcaccgggagaagcactccccacttggagcagcgtgggaggtggcagacttccagccagagcaggtggagacccaacccagggcggtgtctcgggaggaacctggaagcctccactcaggacaccaggaacagctgaaccgaaagcgagaacgtcggcccttacccaagaatggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggcgtgcactggggctatgaagaaaccaagacttttcttgatatcctccgtgagactcggttttatgaagcgcttcaagcctgtcatcggaagagcaaattgtatggggctgtagctgaacagcttcgagagtgcggcttcctccggacaccagaacagtgccgaaccaagttcaaaagccttcagaagagttaccgcaaggtgaaaaatggccacgtgctagagtcctgcgcgttctacaaggagatggatgccctgattaactctcgggcatctgctccttcccccagcaccccagaggaagtcccatcaccttcaaggcaagaaagagggggtattgaggttgaaccccaggaacctacaggctgggaacctgaagagacctcacaggaggcagtaatagaagactcttgcagtgagagaatgagcgaggaggaaattgtgcaagagccagagttccagggacctccaggtctactgcagagcccaaatgattttgaaatcggaagtagcatcaaggaggatccaacacagatagtatataaggacatggaacagcatagggcattaatagaaaagtctaaaagagttgtttcccagagtaccgaccccagcaaatatcgcaaaagggaatgcatctcaggaagacaatgggaaaatcttcaaggaattagacagggaaagccgatgtctcagcctagagatttagggaaagccgttgtgcatcagaggccttttgtggggaagagaccctacagacttctcaaatatggagaaagctttggaaggagcactcgtctgatgtgccggatgacccaccacaaggagaatccttacaagtgtggtgtctgtgggaagtgctttggtagaagcaggagcctgatcagacaccaaagaatccacacaggcgaaaaaccttttaaatgtcttgactgtggaaaaagctttaatgactcctcaaattttggtgcccaccagagaatccacacaggagagaaaccctacagatgcggagagtgtggaaaatgctttagtcagagctctagtcttattatacatcagagaacgcacaccggtgagaagccctatcagtgtggagagtgtgggaaaagtttcaccaacagttctcatttcagcgcccaccggagagttcacactggggagaatccctacaaatgtgtggactgtgaaaaaagtttcaataactgtacgagatttcgagaacatcggagaatacacactggagagaagccctatggatgtgcccagtgtggcaaacgtttcagtaagagttctgttcttaccaaacatcgggaagttcatgtgagagaaaagcctctgccacaccctccatctctgtattgccctgagaacccacataagggaaagactgatgaatttaggaaaactttttgatgatgatcttctcttcctaaatgcccccttagccattttaccctaatctcattcttggaagcaatcttttcttagctatgaagtgtaatttccaagataaacttgagaatataaataaactaaacactttcatcctgttctcacctctgcctctaacttcatcagtctgttcctcctcttctgtgtgtctcagcttctcctttaagaatgtggcgaagatacattgtccgagttcagaatgaaatacccttcagtacattgaggccactgcaactggattgctaagttcggcaacattcaagatcttccatatgggtgagagttgtcttcaaggatataaaaaatgccaaaagtttttttgttgttattacctactccgtgagatcctggatgaaacttgataacagattttcacatttagatagaactttgaggagtctgatcggaactacatcaaatccatcttggttttgaagagatccacaaaagaagagtgaagattttatagctttcctcagaagtctgttacagtgtacctttttttttttttttgtcaagaagttgatccaaatagctagggcagaatccctgtattgtcactgaaatcctgttactaatgccttgccctccatggag

SEQ ID NO: 461460 - DNA, 1004 bp, Homo sapiens
ccccttctaatgtgacttatgaactttatcggtatgaggattcaacaccttttcaacaggtccacgaagaacccaataattctgaaagaaacatcgaaggctggaaaaacatgtcagatgattgtcaggagaatatatgttgcacatctcagtggtgcccatgtaagctgcctatatgccaggtatgacctggtgtctgccagctccacacctgcccttctctgctcagtcatgctggggcttggagtctgtgaactacccttcccaggctcccctgccagctggcttcctgttatgttctgccaaaataaggcactgtcaggagttcagaaagcaagaagagggaagggaaaaaaaggtcttcaattttgcaaaagggcagccatggtacaccactcagttgttcattcacggtcttcaacccactttaaaaggcataatggaaatgacaagaaaacagatacaaaagataagttataccagccaaaatatcaacaaaatggtgaaaaatcttaattccctgtctgcaagaaaaaaaatatttattagtgttaaaaaaaaaaaaaaaaagactgtagaaatccaaaagtcattttgaaagcaacgaccgttttaagggccaaaagagaaatacgggctgtttcgagcgtgaatcaaagtgtcaaagaacatttggaggctgctcggtagacatgcactctctcaaggacaactgagatgcatgcctgactgagtcacggctgagcacccagcgctcagcagtcagctccagagctgcagaaagtaacccagtgagacccgcggtgccggctacaggtccctgacagctgatacccaacttcaatacaaagatcaatttgctgctagtccagagaaattgaccttcgtgttcagactcatgggcagaaaaagtcaacagtgatttaaaaatgaaccccaaatcaattattctaaggaatttaacgctggttcaatgactgaaaattgtcattgcctggctctga

SEQ ID NO: 461461 - DNA, 3056 bp, Homo sapiens
cgccggcggcgcggacctccttgtcaatgggagcgcggggccgggctgcccgcaggacggtcaggtgggccccccagctcgctgccagcgcggcctctgtccctctcgggccggctctccatcttgtcgcccgtagcccgccttctccgtggctctccagccgctggggccgcagagccgaggccgggttacctcaggaaacgcgatgtggtagtgggtcggaataaacccgcgcgccccagaattcgccttgggggcgtaaggacagattcggacttttcgtttcctatgtccacatttattgagcacctaatatgtgacacccgaggctgtaagaagaggaacgcagcgggcggagaaaagccagagctttttctctgtgagccgctgcctccagggccatagccgaccctgctccgagatcccagccgccgctctccgtgcaggaggggtgcccaccctggggaggccagggtgcccggagtggagggacagggcttcaagcgaccgggagtttccagcaaacccctgatccctgagcagtttattttaaaagcttttgcaaatgttggacggtttcgtttggtggaggccgtctttgcactaaattctcctgtcctcccccttcgaaacgcacaaaatgaattttgaacagattttggatgagaggttttcttccttttttcatcttctgaaacatttccccctcatttcttctcagataaagacccagaaacccgggacagttactcggtgtacagctagtcaaatactgaggaaaccaggtcacgaacagttattctccttactactacctgtaagtagtaagccagtgctcctttcacatgtttgtggactatctgagaaactgcatgctatatgcacatataaagtgtgcttcccagacttacagaaagcatacaaccccagaacccactcatattcaggttcccccaaaggacagtattttatatactctctaaaagaaacaacggcaaagccctttactgcatgtggctcctggatctggagggcaattcattatatcaataagattccccagctctgacttacagaatgtgggctctgattagtttgtatctggcattaatgagggaaggtgctgatcaatttttttatgtccctaaaagatgagtcttctattcagcatttccctaactcatacttgtgcacatctctcagacctaccagagtggtggttctcaaatgttgtgcacaagaattacccaagatgctttttaaagagcagatttctgggtttaatccctagaatttctgaatcagtaagtttgaggctaagcttaggaatcttcatttttacattcataccttctccctaagtactcaggtactttgggaaaacattagtaaactgtaaactccttttaggggacagagttgtcttattactttgtatatatccccaaaggtcaaggatggcccactgcccataagtcatcagtttcaatatttgttaactaaacaagggctgatttagcaagggctaaatcagacaatgtgacaaagctcttcccacctctgagacttttttatttttgtggtagaattttttttacttgattattctagaaaatgcttaggattggatgagttcaaaaaggtaatggcttgtcttcaagtaaggctctgaaaaatgaaatgatacagattttaaacaaacaaatgggagatttataggcctatgccagcttgtgagaagagtgtttgccaggtgtttttgacattcccgtcagaaaattttttgctcaattttgtgtcccattttgttattttgtagaattcatgaaaaattagttttcttatttataattttagggataagagatgtcataagaagaaataaaggttttgtgtacttttaagtgaagggattttcatgaaggagcagattaaggtttataggtaattgaattgagctcttaagttattgaagtccattatgtggtcactgttgacaacataatttgttgagtgttctttgatggttgaagaaccccaaagagggtgtgctttgtgattttttttttcaatttaggatagctagagaatcccacagggatgcctttggcttgaatagagtgaaaagttggagggggccaagactagtgctttcacattgacaataaaatggaccaagagctgaaattgaagtcagaagcttggcttaatatgaaagcgttacctaaagtcatggattccaattggaattttcttggaaaacttttcattagaaactaagattcttatttgttttgatgggagtaatagtccttttcaacctacctgggctggagttgacagaaaagattagcaggaacatatttgtaaaatatttatttaatacttattatatcctccagaagacaggagctttcctgacacaaagcatctgctccctcaaaggtgaaaaccagaaattggcagtagatgatatgcaactattaaatataatgtgaagctttagtctcaataggtttggacaaataataaatgaaagtaattttcaaaactgaagggaagtaataccaagaaagtcagcagagtgaaaagaacactggatagaatgaagagacaagactcttagtctctggccaactttgggagacttaattcactttccaggcctcagtttcctcaatcaagaaattggattttaggcatcttttatccgtaattctaaatccgagttgcgaggacagagaacctggaggactgacactgggaagattacagaaggcagagctccagagggcaaagcaagaaaatgttacaaatctatttattcagtccttgaatctgagtatatctgttccactatcaaaatggttccctttacttttttcttccctttaagtcaagcatgaatttttcatatttcgtatagtgtttgctttagaaatataacaccttgtaaacgtaacaagccaatagtatgaaaagactatggattgactttgattttcccacttagaagtgacaccactcctagatatactggaatatttttttagccc

SEQ ID NO: 461462 - DNA, 5303 bp, Homo sapiens
  misc_feature (1)..(1): n is a, c, g, or t
  misc_feature (3)..(3): n is a, c, g, or t
ncnatcagcaccgactcccccgctctcggcgaggcgcctccagctcccgggaatgagaaatgtgcccgccgcagcaggggcccacaggaatgaagggccccggcgctgcgtaggcccaacagttccccgcgctctcgcccccggcccagccccgcctttcttcccccgcctcggcagaatggactcaccagggggcgaagaactcgacgagcatgaggcccgcagagcccgtgtcggagatgcgactctcgaagttgtcgtccgtgagttctagcacgtcggaggcagcggcgaggcgggccgcggcaagaagcagcgccacacccgggaacagcgctaggcggcggaggcgcatggcggcgaggtggggtggggacggccggaagggtcgcggctcggctgggactgcggaggtcgggcgcgcgaccactaacccgctgcttgcgctcgcgcgtctggcccaggcggacctgcagccggaggtcccaacccccaaacccggcttgggccgctgtgtggcagccgctgattggctgcgcgtcgccttcgtcgggcgggcgggaccaactcgttaccgccgagtggccggagcgcggggcggggccgaggcggcgagtgtctgggcgagcgtggctgggcccggtcctgggctgggggcaggggctagggccgggtcccggggtgagccgaaacctgggggtcgggcggggcgggaaatggggcgcagtgaggctgggagccggccctgagctcgtcctgcgtaggggtagccgggctcagggggcgcctgagctggaggtggaagcgtgaagtcaggactgagtgggcgaagagaacctgggctgaggatttaccagctcttacccagcttttacaaatctagacatgcttttctgaagcattcctccctataggtcatttggactgggaaactcttgtgcacgagaatctgcccaggctaatggaaatggatcaggatgaccgtgtttggcccagagactcactcttccgatattttgagttgctagaaaagcttcagtgtaacctagaggagcataagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatatctgttcattaaaattaaaaagtataagtgtctaggccgggcgcggtggctcacgcctgtaatcccagcactttgggacaccgaggcggatagatcacctgagttcgggagttcaagaccagcctggccagcatggtgaaaccctgtctctgctaaaaaatacaaaaaaaaaatttagccaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcagcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtgcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacggctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcggcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaacctgaccctcaggaatctacaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatcaaatgagataacacctgaaagaactttgtaaattgtatagcacgtacaaacaagaagggacctcttcacaagcagaggaagggtggtcctgtggaaaaaaacgggaattgggagtgagagacctcaacatttgatctctgtgaacctcagttttttaatctataaaatggggaaatgttaatggtacttaatatttggagcttttgagtccattagatcagcttgatggtgggaattggccctggagctgtttactgtcagttcctgtccagcttcactaaatttggtctggggtcacatcttagctggggactgtggggttctgtggtcccttctc

SEQ ID NO: 461463 - DNA, 1125 bp, Homo sapiens
ggcctcccaaagtgctgggattacaggcgtgagccaccaggcctggcctgttttgttttgttttgttttgttttgaagacagtatctcattctattgcccaggctagatgcaatagcacgatctcggctcactacaacttctgcctcctgggttcaagcgattctcctgcctcagcctcctgagtagctgggattatgggcatgcaccaccatgcctggctaatttttgtacttatagtagagacggggttttgccgtgttggtcaggctggtcttgaactcgtgacatcaggtgatccacctgcctcggcctcttaaagtgctgggattataggcgtgagccactgtgcccagctagtgacatcttactttctacacaatcttatctgataattctgaataaatctgaacattcatgtaccaacatccccaactacctttttatttttggataaaacaaagtttcttagaactactgctgttatcagtagaactaacttccttcttgcgtttttgtctccaaactctgcttcgttccacggcctgctggcatttgtcatgtgctcttccgccacgtgtgctcttctgccggcatgctcctctcaacgccctctcgaggtccagccgctgtgtcttcttctgccaatgtgttcctctagaagtccagccgcttgtgtgtctgcctgctaggatggagtcccctgtttccacaccagcagtgctgccaatacaccttttggtgccagtggtcaacaatgacatctcatctccctgtgagcagatcatggttcgtacccgatcagttggggtcaacacatgtgatgtggctctggccacagagcctgagtgcttgggcccctgtgaacctggaactagcgtcaaccttgaaggcatcgtgtggcaggaaacagaagatgcaaactacactgtcttcaaacagaaaagtccttacagctcagagagaagctgtgaatgcttggcctctgaggggaatggaggacactgaggtccctgtagaactgagccaccttgctgagaacaggtttctggttttggaagactcgtacgtaatttgacccttccttacagtcagatccatgaattgaggatgaatggtttgccagg

SEQ ID NO: 461464 - DNA, 1731 bp, Homo sapiens
caccgtggatcctccttccatacagaaatgatactctaggatccctgaaatttaggaaatgatactctaggacatggttagagtggacagtgtcctaaaagaagtgcagatgaaatgctctgaagcttccaagggagggagaatttcttccggtgggaagataggccagtggtttgtgacattgccgaagaagccctacagtgccccagtgtcccagatggagtccatcccagcaacctcagaggctgccagcccaccagcaatcctagttacagtagagtcccccgagatggatttaaatgattttgttaaaatcccccttacgtttgggggtgtggtagagggagaagaggaagacagggctgttatgcacctgagactgtgtggcgatgacagcccaatgagtgaatctctgcatttcattaaacttcctaggactgtccttgtggatgaagatgccaggcctgaagaaaaagaactaagaaaaacgaaagcttccagtgtgatctcagatgaaataaaaattagctctactgaaatagaaagaatatactcaagccagagccaggtggaggatcaggaatccctacagacctgtgaacagaatgagatgctttccattgggatagaagaagtgtttgatattttgcccctgtttggagtgttgcagccacacagtagccaccaaatatcgttcaccttctatggacacgctaacatcattgcacaagctaaagctctgtgtgaagtggaagaaggacccacctacgaaataacactgaagggagaggcgtccctggtcaactattcctttgacaccaaggatattcactacggattacagctgtttgaccatgtcacagagagggaaatcacgctgacgaacatggggaaagttggctttgagttcaaggttctgactgaccaccagtcttctccagacaaccttctccctggagtgccactaatcctgcctgtgtctgtaagtaaatggtgggaggggcccgaattcaaacctacgagccccactccgaagcagtaatttaatgagttgaacctgtactgtagcacattcgttttcccttttctggtctttctaccgcgtagggctttatcagttcacatcaagagcaggtattaaaagtttactacctacctggagtacctgaggtctttaaaaggagtttccagatacagatcgcccacctggacccagaaaatatcactctgagcggagagggaatctttccccaaatctgcctcgatctccccaggaacctcacaggtagtacttcacactggagtagttccccactggggacaaaacaagcattttagctttgcttattggaagattgctggctacttactttatttgcttggaaatgccctgtggttctcttccacgttattctgcaattgccaaattggtgacctgagtttactgcgacaagaaatcgtctatggcagccccaagtgaagaaccctggccaatttggccattattgaattactgacagagggatcaggaaatttacctccaaaagcttttcctcccccatgcactttccttctggccccagtctttccccgagctgtcctttccctgtgacattctcctagatgccactgggaaggtaagagccaatgagcttccaggagtagaattctcaaagtataaactgcacagaaaggcggacacagattctgagcccttattttggcattaca

SEQ ID NO: 461465 - DNA, 936 bp, Homo sapiens
ccatacgggtggcctccgtggatatggagctccttcattttgttccaaaaagagctctgccaggctttaccattgccctggaggtgcacaggcgcccgtatactcgagcacaaccatgggctcaccccaagcgcgcacacctgcacccacgcgtggaaactcctcacatctcctttctttcctctgctccccctctctgcccctggtactccggatccaatccttggcttaggaatccactcaagccacgtctggctgctttgttccagaggagcgcagctccgagactgcacttcagcggtgcagcctccctccaggaagaccacagaaataaaccaaagggacaccgcggacagatgtaccagaggacaccactgaagtccaggagaatctccaccaaaaccatcagcgttttccttgtagctttctgtccctcgaagtggaaagttgaggtttctgagaagtccacggagagaacctgcagcaaactgaagccacagactccgaaggcatagggagaaaaaatgcttccatccccctttcactttaaacttgatcgcttctgggacttcactggagggcggtggagttgcaccaacctggagtacaggcagatcccagcgagcacttccaagtactttaggacgtgggggtgactcttttttcttcaggattgtcccacttgccaccctttccagctgagctgataggaaccaatgaaagtctaggcgatgaggattttccgttacctcagggatcaaagtataaaatgttgaatgagaaacccgaagaccttgcatcgctgggctgaataacttgttttcttttttatggtgtccagactgaggtagggaggggacacactgacctagctgtaagaagtcaagggttgggacaaaacaaagttcaaatatatactggaatttgtgtgtgtgt

SEQ ID NO: 461466 - DNA, 1920 bp, Homo sapiens
ccatacgggtggcctccgtggatatggagctccttcattttgttccaaaaagagctctgccaggctttaccattgccctggaggtgcacaggcgcccgtatactcgagcacaaccatgggctcaccccaagcgcgcacacctgcacccacgcgtggaaactcctcacatctcctttctttcctctgctccccctctctgcccctggtactccggatccaatccttggcttaggaatccactcaagccacgtctggctgctttgttccagaggagcgcagctccgagactgcacttcagcggtgcagcctccctccaggaagaccacagaaataaaccaaagggacaccgcggacagatgtaccagaggacaccactgaagtccaggagaatctccaccaaaaccatcagcgttttccttgtagctttctgtccctcgaagtggaaagttgaggtttctgagaagtccacggagagaacctgcagcaaactgaagccacagactccgaaggcatagggagaaaaaatgcttccatccccctttcactttaaacttgatcgcttctgggacttcactggagggcggtggagttgcaccaacctggagtacaggcagatcccagcgagcacttccaagtactttaggacgtgggggtgactcttttttcttcaggattgtcccacttgccaccctttccagctgagctgataggaaccaatgaaagtctaggcgatgaggattttccgttacctcagggatcaaagtataaaatgttgaatgagaaacccgaagaccttgcatcgctgggctgaataacttgttttcttttttatggtgtccagactgagcaaagaaacatatattggggaaaggatactgtattcagtaaattgtgctggaaaaagtggtaagccacatgtagaagaatgaaactggatccccagctctcacctaatacaaaaatcgactcaagatgcatcaaagacttaaatataaaacctgaaaccttgaaaattctagaagataacaccagaaaaactcttctaaatgttggcttacgcaaagaattcatgactaagacaccaaaagaaaatgcaacaaaaacaaaaataaataaatgggactcaattaaactgaaaagattttgcacaccaaataaataatcagaagaataaacagaaaacccacagaatggaagaaaatattcaccaactatgcatctgacaaaggactagtatccagaatttacaaggaactcaaacaaataaatgaattcaaatatcccattaaaaagtgtgcaaaggacatgaatagacaattgtcaaaagaagatatacaaacagccaataaacataaaaaaaaatacagcatcgctagtcaccagggaaatgcaaattaaaaccacagtgagattccaccttactcccgcaagaatgtccacaattaaaaagtcagaaaacaatagatgttggcatggatttggtgaaaatcacatcagtgaatacagatttgggaagaaatgtgcataactggtttcagctagccaacacgctggtcccagtataccactggctacggcattctaaaagtgtcctcatatgtatctattaaatattcaagaactttgaccaatatattctctgccaaatgctctcaagaaatcttggtggagatggtgtcgggggtgaataatttgtttctttatgcactgactattacagagggtataaaaagaggtgtttttactaatatgcacaatgtttttatataaaatgttgctataccatgcagtaatgtgtgaaaacaatgaatgtgacaatattcagttaagagaagttctgtttctgagacaattcttttttatttatttagctatctatttatctatctatctatctatttatttattttactttaagtt

SEQ ID NO: 461467 - DNA, 857 bp, Homo sapiens
  misc_feature (1)..(1): n is a, c, g, or t
  misc_feature (4)..(4): n is a, c, g, or t
  misc_feature (8)..(8): n is a, c, g, or t
  misc_feature (10)..(11): n is a, c, g, or t
  misc_feature (13)..(13): n is a, c, g, or t
  misc_feature (16)..(17): n is a, c, g, or t
  misc_feature (19)..(19): n is a, c, g, or t
ngtntctntnnanccnnancagaagcacactgttgctaaatccatcagctttaatattcgagactgaataagagtgttggagcaccagtgtgagagacaggagggagcccaggctctcaccttcctccaaagaccaagcatggagctgatcagccacaaaattccatccagcatatcagtgtccctgcaggtgacacgcttaggattgaaaatgcagcacaattatcatttccctactcctagaggtagtttttctttcaggcagagagaaaagcctgtgggaaggcccagtgggagcgaggaaggaaaatcgttcaggtgggaagagcagcgtggagaaggaagcaaaggggacagccccctcctggagataaggccagtgccaccgagagcagggcagcactgccctggtggcacctctggggccgccggcctgggctccctggctcctcctgttcctgctactcatgctcccatcgccattggctttacttggaattctcctcctgctactcccaggggctactacggagagaacttgcttctgttcctgggacctaagatcaaaggagccttttctgtcagcgccttcataccttggactcttccagaacttattcttggttaaagccccaaggctttctcatgagagctgctatctggctgcccttgtgcagccgccgcttgggttgactcaggctgcaggccctgagcgtgttgtttaagccttttgtttgttttagtctgtctttccagcatgtcgaagtctttctggtctctgattctgccatcctgtggactttctatagctcccgcttccaatgatccacaaatacggtaaacgtgccttctgggtc

SEQ ID NO: 461468 - DNA, 1938 bp, Homo sapiens
cacacgctccctccctccgcgctctacccctcgcccgcccgccgcgcacgcagccggccccggctcccggcgccccgcgcccgcgccccgcgccccgccaccgccgccgccgagcaaagccgggctgggcttggagctgctcatggagaaagtgccaggcgagatggagatcgagcgcagggagcggaagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 461469 - DNA, 1863 bp, Homo sapiens
  misc_feature (15)..(15): n is a, c, g, or t
  misc_feature (22)..(22): n is a, c, g, or t
ggctggtacggtccnggagtcnttgggatcgccgccgagcaaagccgggctgggcttggagctgctcatggagaaagtgccaggcgagatggagatcgagcgcagggagcggaagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 461470 - DNA, 2275 bp, Homo sapiens
gttcggcacaggccaggctcctgccctgctctgctgccaaagatgagtttgtttacagccaggacacaagacttcctgcttccagagaaaagggcttttttacaagggccaagagagacccagtgaatcagaaacacatggcccaagttccccagcacgctgcccgtcctgccctccccaccctgccctagggactaagatctctccaaaccccaaacattttgaaacggccgaagtctcctcctccgcccacttctgctccttgtggactgaatggagatgggctaccgtggaaactggcaccccatgggggttactcccagctgtcaagtggtggggtggtcccctcatccctttacaccctctagcccacccctagtgtccctggcctgagcctgcagagcctccctgctgccagggtccccatgggctcgagggtaggatggagttacagagtagagtcctagaaggccctcgcccaacttctcttatcagggaagcaggggtgggccaggcgccactgtttattgagccgtctctgctccagggtgtgcgcctttgcgtgggtggggggtggggggggggcgcaatgactgcagggggcgctgtgtgtaccgagaatacgagaatacagatgggtggcccgaggagggacgagacaggccggacagaatgcgccacgtttcagaattaatggaaaaagagctcacattggtatcgtgctttgcagtttgtgaaacacttttttacccagtttatgtcacaagacagacattattcacattttagagaaaaagatccggagctcccatgggccagtagacttgcctgagatcacacagcacgttcgtagcaggacggagactagaacttgggtctcacggttgctttcaactgcactgtgccggatctcttggcaggaagtgagcctcgccagccccaggtcctccccctttcccccgagggtccttccctgcctctggtaacgtttgtccttcccttcctgatctcgtccacagcccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 461471 - DNA, 2646 bp, Homo sapiens
cacacgctccctccctccgcgctctacccctcgcccgcccgccgcgcacgcagccggccccggctcccggcgccccgcgcccgcgccccgcgccccgccaccgccgccgccgagcaaagccgggctgggcttggagctgctcatggagaaagtgccaggcgagatggagatcgagcgcagggagcggaagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgtacctgtgcacactcgtgcagtctcttcctgccaccttccctcacctctgtcccccatccccggttctggacgcaggcctttttcctgaaagtcctcccctgacctcccacaccaagggcgccccatccactgtcccacaccaagggcgccccatcccctctcccacaccaagggcgccccatcccctgtcccactaccaagggcgccccatcccctgtcccactaccaagggcaccccatcccctctcccacaccaagggcgccccatcccctgtcccactaccaagggcaccccatcccctgtcccactaccaagggcaccccatcccctctcccacaccaagggcgccccatcccctgtcccacaacaagggcgccccatcccctgtcccactaccaagggcaccccatcccctctcccacaccaagggcgccccatcccctctcccacaccaagggcgccccatcccctgtcccacaccaagggcgccccatcccctgtcccacaccaagggcggcccatcccctctcccacaccaagggcgccccatcccctgtcccacaccaagggcgccccatcccctctcccacaccaagggcgccccatcccctgtcccacaccaagggtgccccatcccctgtcccacaccaagggcgccccatcccctgtgtctcacctttggctccccctgggcttctctctaaattg

SEQ ID NO: 461472 - DNA, 1774 bp, Homo sapiens
cacacgctccctccctccgcgctctacccctcgcccgcccgccgcgcacgcagccggccccggctcccggcgccccgcgcccgcgccccgcgccccgccaccgccgccgccgagcaaagccgggctgggcttggagctgctcatggagaaagtgccaggcgagatggagatcgagcgcagggagcggaagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagcccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 461473 - DNA, 1176 bp, Homo sapiens
ctccagaaagatttaggacgtcaagtcgtctgaaaagatttcctttttggagaacaagccccgctctttggggtaccggagggtctctaagaagcactgcctgtcccagtttctacaaagttggggccgcctctctgggataggccagtccagctctgaaagctgagccaaggggctgtttctggaagttggaagaatcatggtgaaacggcacaagtatgggctgttcaacaattaaccaggcagcgtggagtatcatcacagagaatctacgatgtgctactgtgtgctctctgctagaaactgaagagatgggatcttgctatgttgcccaggctggtctcgaactcctggcctcaagcaatccacccgccttggcctcccaaactgctgggattacaggcatgagccaccatgcccagcctaatttgggttctttttttaaagtaagattctaactgttaataaactgaggaacctcattgtccatgatattcacaataaatgataataaaaagaaaaacagctgtaatttatcgaaccccgggctggtacagttttgctctggcgagcgctgccacatccattacttgcagccttggaggcaccgccaatcacatgactcatcctgggccaatctctccttaggcggtgaggacatgagagagcagccatgtgcaagccaggaggaggaggccctccccagaatccaacgaaatccatatcatggagtcccaggccaccctaaagagatgcccactgtcctgagtgaccagtggccccctccaggagaaaaagatttttctctgcccatcaccaggatggaagagaaagccagaggcccagaggagagacaagagaaagatggagaccgaggtgtagactcgaggggagagagctcccccctccatgcctacccacccatggtggcagatgcaatagacaacacgggttttgccactggtttggagatcctagcacgcacccattaacctaagtccctcctgctttgctgctgcagaaaatatttcagtgcctctgttctctgctctgggtatattagatcagctccagtctttgtatatgtagctatttataacaatcgtcacccacacatacttccaaaatggatttctcaaagaaattgcaatttctcaaattgcataccatttctat

SEQ ID NO: 461474 - DNA, 4061 bp, Homo sapiens
cagggggctggtaccgcccggagtatgggatcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaagaaacaagtggtacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggaaaagaaagcaaacaacgagaaacagaaagccgaaagggagctagagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtacggagtggaagttagagcagtccatgcgggagcaggcactgctgaaagcgcagctgacacagggccctttccccctgtgctttgggcaggtttgctcgttgaagaaggagaagaagcatgataaatatcgggtagagacgctggagaggagcttgtccaaactcaaaaaccagatggctgaacctctgcccccggagcccccagcagtgccctctgaggcggagctgcagcacctgaggaaggaactagagagagtggcaggagcgctccaggcccaggtggagtacaatcagcgcataagtctcctgaatgaggggcaaaaggagaggcttcgggagcagcaggagaggcttccagagcaggaggagaggcttcagcagctggccgagccacagaacagcttcaaggagctgaacaatgagaacaagagcgtactacagttggagcagcaagtaaaggagctgcaggagaagctaggcaaggagcgtctggaagctgccagccagcagaaacagcagctaacggcccagttgagcctcatggctctccctggggaaggagatggaggaggacatctggacagtgagggggaggaggcacctcggcccattcctagcatcccacaggacctggagagcagggaggccatgagcagctttatggaccacctggaggagaaggcagacctgagtgagctggtgaagaaacaagaacttcgcttcattcaatactggcaagagagatgccatcagaaaatccatcaccttttatcagaaccagggggccgtgccaaagatgcggcactgggaggaggacaccatcaggctggagctcagggaggagatgaagatgaagctgctggagctgcagcagatggtattgcggcttacagcaactacaacaatgggcacagaaaattcctggccgctgcccacaaccctgctgatgagcccggtccaggagccccagccccccaggagcttggggctgcagacaagcatggtggagaggccagggaggatcctctccttgacaagcctactgcacagccgatcgtgcaggaccaccaggagcacccaggcttgggcaacaactgctgtgtgccattcttttgctgggcttggctgccaagaagaaggagataaacatcaccatcatcaaagagctgctcaagaaatttttaaataagaaaccaagttatggggttaatctcctacacaattcatttacttcctttgaatgttagagtcactcatgattatttgtgtttctaatttatagttttaagtttatttgtaaaaagttaaaagagagtgggtgtctgtggctctcactgatgttcactctggcatcctttagcatttttcttttttaatttcataattgtaggtcattagcatgcatatcgagtttgcccttacgtggtgggggttcaaacacacaaagacccactctttgcccaaaactgttctcgctggtttggaataggctgccatgcttttttaatgttattgcagcatgtatattcactacagaattcagacaaaatttgcctatgttctgctgttgtttgatctaatcttaatcacagtgagctcttcgttagctcaatatgtagtttgcccccaagcgtgcactgtttattactttgtaatatgccactatgagtactgacatttagagttgtttaaaggccaagaactggaaacagcctttcctccattttctgtgtattggtgatgggagtgaaaccttttgagggagctttttaaatctcacagaagaggaaagtggcctcctctggcaggtatgtccaggatagagtgtgtttcatctgttccggtgccaggaattagcagtgtattatggtggttcccttaggatttgtatgtgctctgggctcatgaagatactgcatcatgagctgcagcagttgtactctttttcaatgacctaaaaagggcttatttctgaggaatgaaaggttcccatcgttgactgtggatgtggaaaacctttcctagcttagagcatttgtatctacaatacattttaaactcagagttcatgttacctgttttaatcacatgactacatgtcccagtacacaaaagggcactggttggcattcttcttaatgtatttagtaaagatcataagaaatcctttacgagttcaaatgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaagggagttttagtagacggtattatactatctttgaaaatcaaggagaagtttatgaaacttaaaatgtgtacaaactgcagtgcaatctactgttcgtgaatgtcaatgtattatcaggaaacgtgcctatacaatcacagagttatattttctcacagacttctttacaaagtgaaatatgtttttgtatctctgggtttctgttcgggacatattttgtgcaatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttcaactgactcttccaaattttatgaatgtatcaatggtattagattatgaatgtatcaatgtattagataaacccagtttcagaatgataaagaaaaaatgttagaacaaataatgcggctaatgaaacagtggtac

SEQ ID NO: 461475 - DNA, 991 bp, Homo sapiens
ttcgcagttaatttgttacccagtcagtggttttgacaccacagtttggaactttaagctcagtggattttttaattttcccccggctccagcaaagtatagataaagaagatccaaagaggtgcttgaatggaattttcagttcatgttttgctgtgggaataatagtgaagaagatggtaacagtacctattttttttggaacacatattttatgggaagacacagtacccatcccccaaaaaaagacaaataaatatatgcataaaatgactttacatggaattttgttacaaaaagaccaaagaagacactaagatgaagaatgagaatgggggaacataatctaggtagttttgtcaagattagatctctatagggaggtgacatttaagattgacacccaaaaggatagaaggaattagtcacatgacatgtagggagaacattccatttagagggggagcttaggccgcgaccatgaggtggcaatgtgcttggctcatttaaaggactgaaaaatgagcagtgtgactacaagatggtgggttaggaacaaagtagaagtggagacataaatcggggccaaaggatgcagaaattatactctgctctagtgtatggattttatttcattgctatgagaagccacagaaggattttaagcaaagcgttgacatgattccatttgaattttaaggtcacttttgctccttgtggagagtggattgaagaggagcattgaactgacgagacccagtgaaaattctgttccaataatgtggatgtatgatcatgatgatttaataaacgtgaagcaaagaggtcaaagccaagaaatcactggagttaaaaccaccagggatgctaccaaattggatgtagggtgaggaaaaatggagtttcgctcttgttggccaggccgagattgcgccactgcagtccgcagtccggcctgggcgacagagcgagactccgtctcaaaaaaaaa

SEQ ID NO: 461476 - DNA, 1573 bp, Homo sapiens
cacagaagtcaaggtttgggaacctccacctagatttcagaagatgtatggaaacgcctggatgcccaggcagaagtttgctgccggggtggggacctcatggggaacctctgctagggcagtgcagaagggaaatgtggggtgggagcccacacacaaagtccctactggggcaccacctagtggagctgtgagattagggacactgtcctccagaccccagaatggtggatccactgacagcttgcactgtgcacctggaaaagctgtagacactcaacatcagcccatgaaagtagccatgagagaagctgtaccctgcaaagccacaggggcagagctgcccaagaccatgggaatcccccttttgttgaaggctcagttcttaagactgtcccctcacaacctttcagatgccaaacaagagccccagattgttgtacccgttttgtacagaaccaacccagatgttgtaccagatagttatagcttctggctgaccagctacaaatcagggtttccacaacctcctcctcagaaagaagtagaactacctcctcctccgactgagtagaaagtgcttagcgttactatccctcatgtgagacatcctgtgctctgacaatggaaaatgaaaaatcatactcaaagatctatttttgttcacttccaagcaaagtatagataaagaagatccaaagaggtgcttgaatggaattttcagttcatgttttgctgtgggaataatagtgaagaagatggtaacagtacctattttttttggaacacatattttatgggaagacacagtacccatcccccaaaaaaagacaaataaatatatgcataaaatgactttacatggaattttgttacaaaaagaccaaagaagacactaagatgaagaatgagaatgggggaacataatctaggtagttttgtcaagattagatctctatagggaggtgacatttaagattgacacccaaaaggatagaaggaattagtcacatgacatgtagggagaacattccatttagagggggagcttaggccgcgaccatgaggtggcaatgtgcttggctcatttaaaggactgaaaaatgagcagtgtgactacaagatggtgggttaggaacaaagtagaagtggagacataaatcggggccaaaggatgcagaaattatactctgctctagtgtatggattttatttcattgctatgagaagccacagaaggattttaagcaaagcgttgacatgattccatttgaattttaaggtcacttttgctccttgtggagagtggattgaagaggagcattgaactgacgagacccagtgaaaattctgttccaataatgtggatgtatgatcatgatgatttaataaacgtgaagcaaagaggtcaaagccaagaaatcactggagttaaaaccaccagggatgctaccaaattggatgtagggtgaggaaaaatggagtttcgctcttgttggccaggccgagattgcgccactgcagtccgcagtccggcctgggcgacagagcgagactccgtctcaaaaaaaaa

SEQ ID NO: 461477 - DNA, 1668 bp, Homo sapiens
  misc_feature (1)..(1): n is a, c, g, or t
nccagagtatcccctgcctctccggccacctcggcctcttaaagttctgggattataggtttggcctagagctctttcttcttagcggacatcgtctggagacatttttggttgccaggatttgctgggtggccttactggcatctagaagaccgacgctgctcaaccctgttggcgcgctgaacccaaatgccagtggcagtgagcttgcaaatcgttggactcatgatgctttgagtgctctcaggactctggaggtcgatgctggggttcctcgctggcttcctgctgctgatgctcttcccctctctgagctcttttacggaaagcttcgtggcacacttgctgcttttcactgaaaccaggctgtgtggtgactagaagctgcgtattcacatttatttttattgattgatggattgaggctgctgtgcagtggtgcggtgcggctgcgtgacccccgatgaccccagcacgcggttcccagtgagtgtggccggcgttgtgggagtgcagagtctccctggcaccctcacccctggggagcttgtcggctgtttctgtgtcctgccgtagaatgctccaggggttcctggcggctgctgacagccacaggactaggtttgcaggtctgtaagggatttgtaggtgccactcaagatgtgtagcgtctggcccagccagggcagcctgctcctcttccggtgcagtcaaggtttcccaccgcttgtgtgcagggattctgaaggcagtgctggctgctggcacagggctgcaagtttgaaagagaagtagagcaaaaaggtccctgggcccccgtggtggcaccagcacacacgagaggggatgtggtggagggcaccgtcatggaggcgtggccctgggtgtggacagccagcgtgggcccgagcccctgtgctgctgccttctgccctggccacccttctctctgcaggcagcttcaggaacctgcctcctgcactggccgcccctgccctctgcaggcagcttcaggatcctgcctcctgccctggccacccttctctctgcaggcagctttcaggaaagcgcctgtggaggccgggcagcctgaacatgttgactttggcagcaggagctgcccagctctgcttattctgtggcccagcaactgggtgctgatgctggcctttctgtgcatcaaacctggtggttttgccagcttcacgcctctttgtcctggtcaccatgtctgtgagcgcgccggctggtgttttgtcgccctcaggagtgtggccgaggcccaggtgtgggtttcccgtgcccgccgtgacctggcagtgagggtctgtgcttctgtcagtgccgttggcctgagacatgtctgtcctggagaccagcacgtgtgggatccatagtagtgactgcgtctgtcttctcctgacctaggcattagcctgatagagtgctggtaactttgcgagtcaacagtgttttcaaaagcagcttttccttctcttctctttaccccatacccttcaaactgttggctcattttctggaggacaccagaataacaaaataatattttgtggctattaatcctttaaaagcagaggaaaatttttcctagcaggagacataatagggttgtaccttttcagtgttttcagtgaaggcaattttttt

SEQ ID NO: 461478 - DNA, 1875 bp, Homo sapiens
gctctgttttgttgctgagtggtctccgtggtgtgggtggactcagcttatttatccatggtgcctggtaggcaggtacacccggggcagtcacagcaggtagtttatctcctctaatgcaagtccctcccccagttcctcactggtcgagtactatggggttacaatcttcccggaggtcgcctgagtttcattatcccgttccttgagcttctgtgcggaagtgatcctcccacctcggcctcttaaagttctgggattataggtttggcctagagctctttcttcttagcggacatcgtctggagacatttttggttgccaggatttgctgggtggccttactggcatctagaagaccgacgctgctcaaccctgttggcgcgctgaacccaaatgccagtggcagtgagcttgcaaatcgttggactcatgatgctttgagtgctctcaggactctggaggtcgatgctggggttcctcgctggcttcctgctgctgatgctcttcccctctctgagctcttttacggaaagcttcgtggcacacttgctgcttttcactgaaaccaggctgtgtggtgactagaagctgcgtattcacatttatttttattgattgatggattgaggctgctgtgcagtggtgcggtgcggctgcgtgacccccgatgaccccagcacgcggttcccagtgagtgtggccggcgttgtgggagtgcagagtctccctggcaccctcacccctggggagcttgtcggctgtttctgtgtcctgccgtagaatgctccaggggttcctggcggctgctgacagccacaggactaggtttgcaggtctgtaagggatttgtaggtgccactcaagatgtgtagcgtctggcccagccagggcagcctgctcctcttccggtgcagtcaaggtttcccaccgcttgtgtgcagggattctgaaggcagtgctggctgctggcacagggctgcaagtttgaaagagaagtagagcaaaaaggtccctgggcccccgtggtggcaccagcacacacgagaggggatgtggtggagggcaccgtcatggaggcgtggccctgggtgtggacagccagcgtgggcccgagcccctgtgctgctgccttctgccctggccacccttctctctgcaggcagcttcaggaacctgcctcctgcactggccgcccctgccctctgcaggcagcttcaggatcctgcctcctgccctggccacccttctctctgcaggcagctttcaggaaagcgcctgtggaggccgggcagcctgaacatgttgactttggcagcaggagctgcccagctctgcttattctgtggcccagcaactgggtgctgatgctggcctttctgtgcatcaaacctggtggttttgccagcttcacgcctctttgtcctggtcaccatgtctgtgagcgcgccggctggtgttttgtcgccctcaggagtgtggccgaggcccaggtgtgggtttcccgtgcccgccgtgacctggcagtgagggtctgtgcttctgtcagtgccgttggcctgagacatgtctgtcctggagaccagcacgtgtgggatccatagtagtgactgcgtctgtcttctcctgacctaggcattagcctgatagagtgctggtaactttgcgagtcaacagtgttttcaaaagcagcttttccttctcttctctttaccccatacccttcaaactgttggctcattttctggaggacaccagaataacaaaataatattttgtggctattaatcctttaaaagcagaggaaaatttttcctagcaggagacataatagggttgtaccttttcagtgttttcagtgaaggcaattttttt

SEQ ID NO: 461479 - DNA, 2429 bp, Homo sapiens
  misc_feature (26)..(26): n is a, c, g, or t
  misc_feature (29)..(29): n is a, c, g, or t
agcggaacggcggcggccacgggctngcnagaggaagcgctgcccctgcagccgcagccacggccaccgggagctaggagtgaacccctgcgggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgaagaaagtcatagccccagttgacacaggcgacttagaagctgggaggaggaagagaaggcggaaacgcagatcactggccatcaacctgaccaactgcaagtatgagagtgtgcgtcgggcagcccaaatgtgtggcctgaaggaggtgggggaggatgaagagtggactctgtactggacagactgcgctgtctcactggaacgagtcatggacatgaagaggtttcagaaaatcaaccacttccctggcatgacagaaatctgccgcaaagatctgctggctcggaacctcaaccgcatgtacaaactctatccctctgagtacaacatcttcccccgcacctggtgcctccccgcagagaagagctccatgcggccccgggaaagccttgatgcacagaaaccttttgaccaggccctctctgcacatagctatggggacttccagtcctacggtcgtcagcgaaaagcccgcacatatatctgcaagccagacagtggctgtcagggacgtggcatcttcattacccgaaatccccgggagatcaagccaggagagcatatgatctgccagcaatacatctccaagcccctcctcattgatggcttcaagtttgatatgcgagtctacgtcctgatcacatcctgtgaccctctccggatcttcacatatgaggagggcctagcccgttttgccaccacgccctatatggagcccagccataacaacctggacaatgtctgcatgcacctgaccaactatgctatcaacaaacacaatgagaattttgtccgggatggcgctgtgggcagtaagaggaagctgtcgacactcaacatctggctgcaagagcacagctacaaccctggagagctgtggggggacatcgaggacatcatcatcaaaaccatcatctcagcccattctgttctacgccacaactaccgaacctgttttccccagtatctgaatggaggtacatgtgcctgttttgaaatccttggttttgacatcttgctggaccacaagttgaagccctggctgctagaggaatgcaggtttgggatccccagtgccctaatctttaccacggactcatgccttgatcaagaagtaaaggatgcacttctctgtgatgctatgacccttgtcaacctccggggctgtgacaaaaggaaggtgatggaggaggataagcggcgagtcaaggaacggcttttccagtgctaccgacagccacgagaatctaggaaagaaaaaactgagtcatcccatgtggcaatgctggaccaggaacgatatgaggattctcacctgggaaaataccggcggatctaccctgggcctgacacagagaagtatgcccgcttcttcaagcacaatggctccctcttccaagagactgctgcttccaaggccagagaggagtgtgccaggcagcaactagaggagatccgccttaagcaggaacagcaggagacctcgggcactaagaggcaaaaggccagggaccagaaccagggtgaatcagctggggagaaaagccgacccagggcagggctccagagcctttccacccacttggcttacaggaaccgcaactgggagaaagagctgctgccgggacagctggacaccatgaggcctcaagaaattgtggaagaggaggagctggagcggatgaaggccctgctacaaagggagactctcatccgaagcctgggtattgtagagcagctcacccgtctgcagcaccctggcccccagggccagaaaaaacttcatgagaatatgacatccagcaagttgcagctccaaaccttctcatttacaggaaacttgctctctatattcctgtcccaaaataaccccacactcatgactgacaaataacaagcccaccaccctcagtggcttctgtataattttctccctagcactgccagt

SEQ ID NO: 461480 - DNA, 2069 bp, Homo sapiens
  misc_feature (26)..(26): n is a, c, g, or t
  misc_feature (29)..(29): n is a, c, g, or t
agcggaacggcggcggccacgggctngcnagaggaagcgctgcccctgcagccgcagccacggccaccgggagctaggagtgaacccctgcgggggagcagcttccccctcgcgatcgtggggacagccagtcctgtgaaacgaggaggcggttccggacgcccagaaacgcccagggagacctggagccgggggaagaggggacatgagcggccagctgagtccatccccaggcggctaggggcggacccagcagcccctcagctctcctcgtaaccacggaatctgagagaatggagccgagtacctgtaggaccatggaatcagaggaagactatgttgaggaaaaggaatctgagaagtgtgttaaagagggagttaccaacccctctaactcttcacagcaggctctcttaaaagctgactataaggcattaaaaaatggggttccctcacccattatggccacaaaaattccgaagaaagtcatagccccagttgacacaggcgacttagaagctgggaggaggaagagaaggcggaaacgcagatcactggccatcaacctgaccaactgcaagtatgagagtgtgcgtcgggcagcccaaatgtgtggcctgaaggaggtgggggaggatgaagagtggactctgtactggacagactgcgctgtctcactggaacgagtcatggacatgaagaggtttcagcccctcctcattgatggcttcaagtttgatatgcgagtctacgtcctgatcacatcctgtgaccctctccggatcttcacatatgaggagggcctagcccgttttgccaccacgccctatatggagcccagccataacaacctggacaatgtctgcatgcacctgaccaactatgctatcaacaaacacaatgagaattttgtccgggatggcgctgtgggcagtaagaggaagctgtcgacactcaacatctggctgcaagagcacagctacaaccctggagagctgtggggggacatcgaggacatcatcatcaaaaccatcatctcagcccattctgttctacgccacaactaccgaacctgttttccccagtatctgaatggaggtacatgtgcctgttttgaaatccttggttttgacatcttgctggaccacaagttgaagccctggctgctagaggaatgcaggtttgggatccccagtgccctaatctttaccacggactcatgccttgatcaagaagtaaaggatgcacttctctgtgatgctatgacccttgtcaacctccggggctgtgacaaaaggaaggtgatggaggaggataagcggcgagtcaaggaacggcttttccagtgctaccgacagccacgagaatctaggaaagaaaaaactgagtcatcccatgtggcaatgctggaccaggaacgatatgaggattctcacctgggaaaataccggcggatctaccctgggcctgacacagagaagtatgcccgcttcttcaagcacaatggctccctcttccaagagactgctgcttccaaggccagagaggagtgtgccaggcagcaactagaggagatccgccttaagcaggaacagcaggagacctcgggcactaagaggcaaaaggccagggaccagaaccagggtgaatcagctggggagaaaagccgacccagggcagggctccagagcctttccacccacttggcttacaggaaccgcaactgggagaaagagctgctgccgggacagctggacaccatgaggcctcaagaaattgtggaagaggaggagctggagcggatgaaggccctgctacaaagggagactctcatccgaagcctgggtattgtagagcagctcacccgtctgcagcaccctggcccccagggccagaaaaaacttcatgagaatatgacatccagcaagttgcagctccaaaccttctcatttacaggaaacttgctctctatattcctgtcccaaaataaccccacactcatgactgacaaataacaagcccaccaccctcagtggcttctgtataattttctccctagcactgccagt

SEQ ID NO: 461481 - DNA, 861 bp, Homo sapiens
gggttcacgcgattctcctgcctcagcctcccaagtagctgggactacaggcccagctccatgatgatgcctctctccagagacctcctgacctcctgacctgcacagcccgggagaccacagcccacagccgctgccccaggtgtccacaagcatctcagcccctccacagcccacgcatctcctctttcattggctcatggggagtgaaggacaatgtctgaattaaatgccgtgctttaaactgaaagggaaacttagcaaataaatgagagtaacaacactagatcattggccagtgtggttgcaattcttcctttccctccagatttctgtttaacctttaaatctcatttcggcatgcctcttggtcctccttggattgatattaagttgtacacaggctacttcttggtgaccctgggaaattccaccctctgctccctccgggccgcagtgtgtcgaccacagaatgagaagattgggccagagcagcttgtctggccctgcgagtgccggcggaataacattcgcgtggtgtacctgggaggccagcagctccgggagcaaccagccgcccactgcgtggccagagtgtcttgcggcccgcctgtgaaggacagtcctgctcatgataagcctgctcgctgtagctgcaagctgacatttaaggtttctcgtctcccgaggagctggtccaaagggttatttggacaagcttacgaggcccgtgtcaggagggcagtttctgatggtgcgatttgatcaggtcacctggcctacatgagcctgagttttcccgtctgtgtaatgtgaatgacagtagtagtgatctttcaggcactggtctgaattacttgc

SEQ ID NO: 461482 - DNA, 991 bp, Homo sapiens
gcaaacccactgtgtgcctggcgcccttgcggtcatcccagatttttgcccacatccctctgttccacccagaggccacctgcatgcaggcatggtggatggttgctgtgtgcagtgatggcctcctgggacctcttgctggccacggagttaaccaggagggaccatcaacctcggaaggcccagctccatgatgatgcctctctccagagacctcctgacctcctgacctgcacagcccgggagaccacagcccacagccgctgccccaggtgtccacaagcatctcagcccctccacagcccacgcatctcctctttcattggctcatggggagtgaaggacaatgtctgaattaaatgccgtgctttaaactgaaagggaaacttagcaaataaatgagagtaacaacactagatcattggccagtgtggttgcaattcttcctttccctccagatttctgtttaacctttaaatctcatttcggcatgcctcttggtcctccttggattgatattaagttgtacacaggctacttcttggtgaccctgggaaattccaccctctgctccctccgggccgcagtgtgtcgaccacagaatgagaagattgggccagagcagcttgtctggccctgcgagtgccggcggaataacattcgcgtggtgtacctgggaggccagcagctccgggagcaaccagccgcccactgcgtggccagagtgtcttgcggcccgcctgtgaaggacagtcctgctcatgataagcctgctcgctgtagctgcaagctgacatttaaggtttctcgtctcccgaggagctggtccaaagggttatttggacaagcttacgaggcccgtgtcaggagggcagtttctgatggtgcgatttgatcaggtcacctggcctacatgagcctgagttttcccgtctgtgtaatgtgaatgacagtagtagtgatctttcaggcactggtctgaattacttgc

SEQ ID NO: 461483 - DNA, 1461 bp, Homo sapiens
tcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagtaaaggagttgtggggttacagaggggttagccgcttcccaaagatcctggagaacctaagactccaaaagcgtggtactggaggagtggacactgctgccacaggcggtgtctttgatatttctaatttggaccgactaggcaaatcagaggaccaaatccccgggggggaccccacaactaggagaaagagaggaacaattatccccccagatctaggcttcatatcctttgccctcgttggccacgggtccccataaccagctcaccagtcccctctatgcatttactcccttcccttcttccttcatctcaccctggggatcaaggaaattgcctcagtagacagagtgaatactaggcgtccagcttgctctacttcatcctggctccacaactctggtttcctggggacaggaagaaaatc

SEQ ID NO: 461484 - DNA, 1101 bp, Homo sapiens
aacgggaaatcgtgcaagtagtagtgccgtgattgtaattcgaagcagcgattgctgtgatcctatgagactgacacaatgtatatatccgccggacaatgaatactacaccagggatctacatgcctatctaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaatagccgcttcccaaagatcctggagaacctaagactccaaaagcgtggtactggaggagtggacactgctgccacaggcggtgtctttgatatttctaatttggaccgactaggcaaatcagaggaccaaatccccgggggggaccccacaactaggagaaagagaggaacaattatccccccagatctaggcttcatatcctttgccctcgttggccacgggtccccataaccagctcaccagtcccctctatgcatttactcccttcccttcttccttcatctcaccctggggatcaaggaaattgcctcagtagacagagtgaatactaggcgtccagcttgctctacttcatcctggctccacaactctggtttcctggggacaggaagaaaatc

SEQ ID NO: 461485 - DNA, 1864 bp, Homo sapiens
taaaaatctcttcaaaccctgctttcagctctttcgcatgtgcctggcagtggagttgctgatgacctggtggttgtgtgtttcatcttttgtggaactgctggcagcggagtttctgatgacgtggtggttgtgtgtttcatcttttgaggaaccgctggcagtggagttgctgatgacctggtggttgtgtgtttcatcttttgaggaaccgctggcagcggagtttctgatgacctggtggttgtatgtttcatcttttgaggaaccgctggcagcggagttgctgatgacctggtggttgtgtgtttcatcttttgcggagccgctggcagtggagttgctgatgacctgcgtcgtggacagcttgcatctgctggacaaagggatgattcgtgtcccaggtggggcagaggagacgcaggtaactgaaactgtggaaagccagaaagcagagcttctgtgtgtgtctcagtactcagcgtggtggagtggcagcgtgggtagagcccctgccggcacccaagtccagcggcctcaaggggcagcacgtgcaaggctggagctgcggctgaccctgtgcgctctccgtggagcacacattgatgagaaagactggcagacatgccagggaatgcagatccgggtcctggcaggaacaaagtgagcctgtggcttcaaggagaacaacggacagtgttagcagtattaaaattggagctttcagttgaaaattggacttttgtgtgctcaccagcttctcagtgtgtcaggactttctcaggtgaccattgcaggatgtcacagaatcatgcctgggtaaaagacccattcaaagttcaagatagaccaatggatttcagaagaaccaagttggaaaagtgtggtgatagggttcaattgcagctcgctgtaaggagccttcccttgctgagtgcggtgtcagggagaagctctgagcacactgaaaaggcttttagatgcccctccctctctagctgcatctcttcctggggctgtaatgtcctctcctgcttgagccacagcggcccttcatggtcgatcgcatgcagatgggaggccaggggttttccagggtcagcattcaagagattcgcaaaaaggcaaagaatgctattcctctcaccaaatattttaaaaacagtttcataaatatttgttactatatattggatatcttgttattgttaaataatgagatatctttaagtgtctcttaatttctaatatcgtacgtatcaatagaaatgacacatataaaccaagtaaacacagggaattgatatttactgtattcaaaatcagaagagacatttaaagatacttcatgtgtgggctgtgctggagcatgagctgagcctcagttcctgccacctctgtgtttagtttccggattttccatgtttcctatctgtttcctgtctgtttccctgatccagtttgggttggttgctactgagcatgcaggttccctttctgtagttacattgtttagtgaaaaaaagcaaggttcagcacagagcataatatatatgctcaggtaaaagggggcaatgattgatggatggagccccagtatattgataactgcctctgggaatggccctggaggcatgggataggtggtcaacttcacagtgtaccttttagagtgggtgggtattttttatttacaagtatttcatttgattatgaaatatttcatatatataaaataatacagtgtttacacaagcgtaaagattaataagagaataaaacaaagtgctgggattacaggcgtgagccaccgtgcccggcctctaatgtgtaattaatcttaatgatttccattaacagcaaa

SEQ ID NO: 461486 - DNA, 1834 bp, Homo sapiens
cagctgccacctgcaggtggcgggcgtcgagttaagcctctttcgggtggagcagtgggcctggagccaactcaggctgagtcaagtgtgagagggagcttcctccgtgtctggggtgggggatgggggggtctcaggcagggatactctagccccttgactgctgtttagaccctgctgtagctgctgctgctccctgcccagccccagccatgaaactgcccaaggggaccaggagctctgtgtactttgcacagcacccagaaaaggagccattgccctcaaggcaggaggtcaagcagacccctgtcatcatggccaagatcaaaggtccggggcccgccaagtacctccggccatcctgcacgggctacatagatcatgacatctccatgttcaaggcaccagcttataccctgcatagccggcactcagagaagcggatggtgtgccacagcagccctgggccttgctatctcttggatcccaaaataactcggtttggaatgtccagctgcccgcaggtccccatggaggagcgcatctccaacctgcgcctgaaccccaccctcgcatcctgccagtactactttgagaagatccacccaccgggggaacgcagggctccccagtacacgtttggctaccggcgcccatacagagtgatggacctcaacccggctcccaaccagtaccagatgccactcttgctggggcccaacacccctgtcagccgagctgctccctgctacagtctggcctccagggacaagaactggttctacaaggaggatgtggcaggaggccctggacctaccacgtacgcccgacctgagccatccatctatcagaaccgcagccctacttacagcatggccaagcgcttcgcctaccctctggacctcacgccacggcctggccccggctcccacgaggtccagcaggtcactgtgcacaagccccacatccctgctttcaccatgggcatcaagcactcactccacctgtgcccactggtcatcgacattcgtgactgaggcccctcttggggcactcactgcccctcatccccagaaattatttttctacaccaaattgagcaatttgaccaagatttctagtagcagagccggtacctgctgagtgtccggcacacagaagacattagagatacattttcatgtatttgttttttccttttctgttcacagttgcttcctgtgggtcctgctctgggtgaggggctggggacactggaaggaatgatacagtccctgtccttgaagagttccattctggttcaccaggtggggaagccatgtgtctgtcctccaaggagccccaggcagagactcgggagagctgcattccagtcctaactgccattacaggctgtgtggccttgtgcagctcctgcccctctctgggctcaggattgccctttagacagtgcacagggtaggcttggaagaggtctaggttctcccaagttccagaactgtgggactgtgctgacagtgtgcagtccccgagacaggggcagggcaggtcggggtgcaggcagaggagcggagtccctctggttgggagttgggagaggagtttcctcggggagggacctaagaggacaagaggagactgctggggagggcgaaggtggaggtcaaggtgagggaacgggcacagagagtttatgacctttacacacagagtggtggggcatggactcaaacccaggtctgtctgttctctggagaggcacctgcatttggaggtgaaaactacccctgtggccatatgacagtccactgtgaccggacactgaaatgaccag

SEQ ID NO: 461487 - DNA, 1526 bp, Homo sapiens
  misc_feature (3)..(3): n is a, c, g, or t
  misc_feature (10)..(10): n is a, c, g, or t
  misc_feature (13)..(14): n is a, c, g, or t
  misc_feature (17)..(17): n is a, c, g, or t
gangcctgtnaanncantcttccccagcgcacgttctgtacttctggccctggagacggaccagggggaagtgccatggaagatgaggtgcctgctttcttccaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggcattggacaacaggcagcacaatactgcaatcctcgaaaaggaaggaaaactcatgacgaatccccatgattatcctggttctctgcctaaggacaatttcctgactacaattcagtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacagaatgccagatgcccgacatcgccctgccctcccagtttgtggtgcctgccaactccgagcccacctgacgagttcccctcactccagctccagctgacttccttcttcaggctggtcatttgtgttggtttcaatgtctagttatcctgaaaaatgtggccatggatctcctggtacatgtatcctcccaatgcgcataggcatacgttgttccacagcatatgcctaggagtagaaccacaggtcatagagtgtgcatagctttcactttagtaggtaattgccaattagtgatgagagttcctaatgttcaacgtcttcaccaacccttggtattgtcggtttttttaaggttactaatctgataaactgctaactcctcgtggacttaatttccctttttacaaacagattgatttcagttgggtaatattatatataggagatctgcatctgtgttcatgagatgaggaggataatctagttttagggttgttttgaggatacctggtaagctctcaatacttctgctgctttttatgtacttagtcagtccaacatgctaaataagaatgaattctgggtcttgtcttgcccatgttttc

SEQ ID NO: 461488 - DNA, 1459 bp, Homo sapiens
cagaagcttcagggaggtggctcaggcctaggctgcaagcagggaacaggtaccagcaaaatatgctaggaagcttctcgctgggaggctaatataaatgggtgggccatttgctaggatacaagagaaacttgccattgggctgctagggaaactcgcccagggacgtgcgcccctgggtctcccacacgccagtgacaaggagacctggggctctctggcaagaaccacaagaagccccttcttcctgctgtgtccctccagggccctctactgacagacccaacaccgttccagctggtaaaggaggaccctccggaggcccagccccaggatcaagaaaacagagcaaaacatgggtcgacctggagttgatccttaattgatgatgggcacaacatggagcctgaaatcatttatttcattttcaagtttcaggctttctgacagaggcaaagcacctagccataaattgcagaaatgcttcattgaccacggattaccatggtggggctggagccaatgtccttctccaggatgtgaatggaaatatcccattagattatgctgtagaagggacagaatccagctctatcctgttgacctatctggatgaaaatggtaggcaaaaacttttaaaaccatagaaaaaaatagattgggagaattgtaagtgtgtattcattttcacaggtttgcttacatgatttccgatggatgtagtttccgcacgagcatcaatccagagtgtattcttgggtccgctgtgctaggctttctcttgatgtttgctgccaggatgaaatcagataagagacaaagtgctcagaagagtggctggttcatagcaaacacttgctgtgagggaggagtggatttgacctcactgcgccagatgaagcttcagagaccaatgagtatgttaacagatgtcaaacacttcttatcatctggaggaaatgtcaatgagaaaaacgatgaaggagtaaccctgaaatgggatgagaaggagcaagcactgaggaaggaggaaaaccaagaggacgaaatgtcctcggaaccaagtgaaaactttgaggaagcaggaggaatgatagactaccaaatactgctgagtgatgtcacttcactggccgtctttcctaatgctcggaatttgcatatgatggttcctctcctgtccctgtacaagcaccctgcatatcccgtatcataaacacagccttaccacaacttgcggtagttgtcagttcattcatctgtatcaccttttagtctgtaagaagtgaatgcaggaacatttgtttggcttgtcaaaatatcatcatatctcagacaggagccaacacagaatactggctaagttactatttatttaatgagagaatcaataaatgccctaatgatcactgaataaatgtgtgagcagtaggtgagtgcgcacgccccttgagactgg

SEQ ID NO: 461489 - DNA, 2154 bp, Homo sapiens
cagactccttaggaaaaacgagagctcatgaaacagtgtcttgctctgacacccggggtggagtgcagtggcatgatcatgggtaatggcagcctcacctcctgggctaaagagatcctcaccttggcttcccagagtgcttggattacagatgtaaaccaccacactgagcccacccttgttatatctgatatgatctgttatcaaaagggaaatggccttattactgataaagttttggtggtctggatagaagatgaaactagccacaacattcccttaatccaaagtctaatccagagcaaggctctaatgctcttcaagtctgtgaaggctgagagagtcattgagtggctgaatgaattaaaaaacaggatccaaccatgtgctgcctgtaagacactcagctttaaggacaaatacagggtgaaagcggggaaatgagaaaagatactccatgcaaatagtaattaaaagagcaggagtgtctatacttatatcttagaaaatagactttaagtcaaaaactgacacaagagacaaggtcattatagaatgataaaagggtcagtcaggaagacaaaacaattataaatatatatgcatccagtatgagggcacctaaatatgtaaagcaaatattaacatacctgaagtgaaaaataaacaacaatacaataataaaataagacatcaagacacaactctcaacaatggataaatcatctggacagaaaatcagtgaggaaacactggattttaaccaaactatgggccaaatggacctaacagacatatacagaacattccatccaacaacagcagaatacacattcttctcaagcacacatggaacattctccaggataaatcacatgttaggctacaaaacaagtcttaacaaatttaagaagattgaaatcatgtcagatatcttttctgaccacaataatataaaactggaaatcaataaaaggaaaatttacaaatatatggaaattaaacagtcaataaatattaaaagggaatcaaataatatcttgatacaaataaaaataaaaaacaacttaccaaaacttatagcaagtggcaaaagcaatactaaaaggaaaatttatagcaaaaaatgccctatgttaagaaagaagaaaaaggccaggcgcagtggctcacacctgtaagcccaacattttgggaggccgaggcatacagatcatgaggtcaggagtttgagaccagccaggccaacatagtgaaaccctgtctctactactacaaaaaattagttgggtgtggtggtggtcgcctgtaatcccagctacttaggaggctgaggcgggagaatcgcttgaacctgggaggcggagggtgcagtgagccaagatcacaccactgcactccagccctggcgacagtgcaagactctgtctcaaaaaaaaagaaaaaagaaaaatttcatacaacgtaactttaaaccctaatgaattagaaaaacaatgttcaaagccccaagttagcagaagaaaggaaataataaatattacagcagaaataaatacagactagaaaaagcggtagtaaggactaacaaagctgggcattgctttttgaaaaggtaaacaaaattgacaaacctttagagtaagaaaaaagactcgaagtgaaagaggagacattacaactgatgccacagaaatacaataagattataagagactcctgtgagccttcatttccaacaaattgaataatctagaagaataaataaattcatagaaacataaaccttccaaaactgaatcatgaaggaaatataaaataccatcagaccaatagcaaatgagagtgaatccataattattaaaaaccttcccccaaaaaaagaaaagcccaggactggatggcttcacaggtgaattctaccaaatattagaagaagaattaatgccagtccttcttcaactcttcgaaaaagttgaggaagagggaacgcttctaaactcattttatgtgactagcactactgtgataccaaagccagacaaggacactaacaataaaactataggtcagtgtctctgataaacatagataccaaaatcctcaacaaatagcaaactaaatttgacagcacattaaaaggatcgtatatcc

SEQ ID NO: 461490 - DNA, 721 bp, Homo sapiens
atagctgttctcgaggatcccgagggttcaagtaactttaaaccctaatgaattagaaaaacaatgttcaaagccccaagttagcagaagaaaggaaataataaatattacagcagaaataaatacagactagaaaaagcggtagtaaggactaacaaagctgggcattgctttttgaaaaggtaaacaaaattgacaaacctttagagtaagaaaaaagactcgaagtgaaagaggagacattacaactgatgccacagaaatacaataagattataagagactcctgtgagccttcatttccaacaaattgaataatctagaagaataaataaattcatagaaacataaaccttccaaaactgaatcatgaaggaaatataaaataccatcagaccaatagcaaatgagagtgaatccataattattaaaaaccttcccccaaaaaaagaaaagcccaggactggatggcttcacaggtgaattctaccaaatattagaagaagaattaatgccagtccttcttcaactcttcgaaaaagttgaggaagagggaacgcttctaaactcattttatgtgactagcactactgtgataccaaagccagacaaggacactaacaataaaactataggtcagtgtctctgataaacatagataccaaaatcctcaacaaatagcaaactaaatttgacagcacattaaaaggatcgtatatcc

SEQ ID NO: 461491 - DNA, 2729 bp, Homo sapiens
ccagggaagggcagaaggtgggaagggtgttccagggagaaggaacagcaaacacagagacctagagaaagtctcttctgggcccggccctggaccaggcgatacctgggacttggagatgattcaaacccagtgtctgcccttggggagcctccatcctggtggggaaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggtacgggggtgggggccagctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaagccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctgatgttggttttactgttttcgttttgaatacacaggctgggtcaggagcagtgagatttgccagcactcagggttctaagggtcttgggccagctctggatggaggaagagccccacatgcccagagcaaggccccccattaagggactgcagccacctccaagggctcctccctccacccaccagctcccaaatgccagagggagcctcttcgccctccctccctgcccaccatccctcaaccatcagcctggcgttcaaagcctttccaagtcccacctcacttttccctctcccaaaggtgcccaggctctgggcaggccctgctcatatccctgatcatggcacattctctggaggaccctcctgttctcgggtaggggccgtgccccacctaggtagccgtcccatgtgggatcctgtaggatctctaaaacctagctctggccccaactttctgtctgccctggaggtttctcagcctcctgagagctctgctgggccccggtctgggcagaacctgggcctaaacaaacaagagccagggcagccagggtctctgcgtggctgggcccagggcttgccctcagagctcacctgtccaacagaagaggagtgtgcctccaccttccctactgcccgcccctttttcagggtcttagggcctctagccctgtggtggggtgctgggtgccccaggtggagctgaagtcatggggctgttgaggagttggtgtccacctggagtctgtccaagctggcccttggggctccttgatgaaagggctggctggcaaattgctgttattgcaaggtcaaggggtggatgaccccgaccccccaccccccaccccccaccccgcggcttgccaggatctcgcccaccagcactcatgctgccccacacccaaggtcaactcttccgcgagcagaaaccaggactgagcctaccaggatataacttcgaagcctgggctggacgcctcttgcaataccaggctgctggggaagtgagaccaggcccgtgcttggcctcagtgtcagcatctcccctgctgcagatggcaggaggtgcagagaggctcccacaggccagcccccacccgcccctaccttgagcaagggctcctcgtcgcgcaggaagatctgccgcttcttggcgatggtggtgcttggacctactccctgctcccctgctcctcccatgccccagagtcccttggggagcaagtcctagactcatcctgactcagaccaaagcctactgctatgagaggagctcagacctgttgaatgtctcacgtcctccccctcccatgaaccttccgtggcttctcccttggcctcagggtaaactcttaacacttcagactcaagatctggctccacttacatgtccagcttcatttactttatatcctctcc

SEQ ID NO: 461492 - DNA, 1899 bp, Homo sapiens
tcttgaagaatgacagtggattatcgtaagcttaaccaagtggtgagtccaattgcagctgctgtaccagatgtggttttattgcttgagcaaattaacacatctcctgatacctggtatgcagccattgacttggcaaatgcctttttctccattcctgtccataaggcccaacagaagcaatttgccttcagctggcaaggccagcaatatacctttactgtcctacctcaggggtatatcagctctctggctttgtgtcataatcttattcgaagagaccttgatggctttttgcttctgcaaaatatcacactgctggtccattatgttgatgacattatgctgattggatccaaactacaccccgtttctaggacatctctgaaggacagcagtgaagggaaatcttcccagtgggcagaacttcaagcagtgcacctggtcgtgcactttgcaggtaggaacactgtcaccaggacacataacgacaattccattaaactggaagttaagattgacacccggacactttgggctcctcctacctttaagtctatgaagcctaagaagggagttacagtgttggctggggtgattgaccccggctatcaagatgaaatcagtctactactccacaatggagatgctgagggctctgtttacctggtgacacccaaaattctatggagacaacaatgacaacagaattaccacagagaactagaaaatgaaactcagctgaaaaacggccacctaagatggaagaagccatgagatgagtaagcgttgcctactcacaaggttgcaaactgtccttcacttacgattatcccccaacgccccctcctaaatctgatcaatcgcatggaacttgatggttacaaaagacagagctaacaactagctaccttgcaggaacgggaacgtcattctgagggtagtccacatgcaagtgttctaaagttgacatcactgcttcatcattcacctcattttcccagaacagaagcaccaagaaaattatcaccattattatcatcagagattaagaagcagcaatgcccctcttgtggcaagagttggcagcgtgcggttggtatgtcaatgcatccaaggtccaagggcctggattgtctgccaaatgcttgggagttgtttgatcaggttgacatgctccaacagcattgtggactgggcccacacctacgctgaggtgaccaatgtctccaactgttggatctgctccaccttccagcagcagctgcggagagtttgccctggaacgcgtatcctgcttctgttaagaactggacatggctagaagcttggggtcccacggacaatgggtgggatgccacagggcgggctttggataggaggcatcacaaaacccatggcaaacctggcccttggctgactcatagtgtccatgatggatggagctggctaatgggagaacacgtggtgcccccattgcaggtatcacaatgtatagagcagcactggggtaaagtcactgtgggatggttgcctactgaggtttgtgcaaacataacatgtgtcaccacaccaagggtgcagtggaacaagcggccttacgaaggccaggcccccatggactttgtgccccctgggagtttatgggtctgtggggacacaggatggccatatctcccagccaactggactggacattgtacctggggttggccctatgtgcctgccactgggcttcccacattgcctagtcgccacataactgggagccactgtgttcctgctttttcccagtgcagcaggccctctagtggttctatcccttagcaatgactatccctggagcaggcgtcattactatagaaaagcaagttgcagcctttgcagaccacacagctc

SEQ ID NO: 461493 - DNA, 570 bp, Homo sapiens
tttatggtttaattcagtaaagattattttattgaagcagaataaaacaatcccaacccagcaatacaggaaggataaattaattaccagtggcttccccttccgctcaaggcattgccccatgtccacggtccaggtctgcctcaggcacagccagctccaatgccattgagagaagagatctcagactcgggagctgatcttgagttatttaacatagccaaggaaactatctggcctcaagtcatcacaagtgacaagaacaaacccctctgtgggggaatagtggtacctgcaggcagggtatcttgtgccttcaatgagctgacagactgtcattttgaactttgtctcactctgaaagcagaaaatggccgaaaggttttggcaagcaaccttcttgggagaaatgcaaataccattgatttttcgaggcctctcatggatgaagacatgctcctttttacaagtgtggtcaggttccctgataactctttgtatgatcatgtggttgcagtaccttgcaggaacgggaacgtcattctgagggtagtccacatgcaagtgttc

SEQ ID NO: 461494 - DNA, 2670 bp, Homo sapiens
tcttgaagaatgacagtggattatcgtaagcttaaccaagtggtgagtccaattgcagctgctgtaccagatgtggttttattgcttgagcaaattaacacatctcctgatacctggtatgcagccattgacttggcaaatgcctttttctccattcctgtccataaggcccaacagaagcaatttgccttcagctggcaaggccagcaatatacctttactgtcctacctcaggggtatatcagctctctggctttgtgtcataatcttattcgaagagaccttgatggctttttgcttctgcaaaatatcacactgctggtccattatgttgatgacattatgctgattggatccaaactacaccccgtttctaggacatctctgaaggacagcagtgaagggaaatcttcccagtgggcagaacttcaagcagtgcacctggtcgtgcactttgcaggtaggaacactgtcaccaggacacataacgacaattccattaaactggaagttaagattgacacccggacactttgggctcctcctacctttaagtctatgaagcctaagaagggagttacagtgttggctggggtgattgaccccggctatcaagatgaaatcagtctactactccacaatggagatgctgagggctctgtttacctggtgacacccaaaattctatggagacaacaatgacaacagaattaccacagagaactagaaaatgaaactcagctgaaaaacggccacctaagatggaagaagccatgagatgagtaagcgttgcctactcacaaggttgcaaactgtccttcacttacgattatcccccaacgccccctcctaaatctgatcaatcgcatggaacttgatggttacaaaagacagagctaacaactagcgtaagtgcaccttcttctttgacatgaccttgaactaagtccaaatgagcaatgaacagctgaagtctctcaactgaaaagatcaggacagagagtgctctccaaagcctgtgacccacccatgcctgctctaggtcactgtatgagtctctagctctcacatacaggattgaaatgccatagctcagaattagtgacaacataatctggcctttatttgccaattgccccttatttcttactacctcacaatacaaattctcccctccaacaatggctataatatagccattttctgtactacttaagaaatagaattatagactaatagacttggaaagaacttgaaagattatctaattcaagatcctcactttacagacaaggaaactaatgaatagagaagaagaggacttcatgaaatccccagaattagaaatctctctttctcgtccttctccttctagctcagaaaatggccgaaaggttttggcaagcaaccttcttgggagaaatgcaaataccattgatttttcgaggcctctcatggatgaagacatgctcctttttacaagtgtggtcaggttccctgataactctttgtatgatcatgtggttgcagtaccttgcaggaacgggaacgtcattctgagggtagtccacatgcaagtgttctaaagttgacatcactgcttcatcattcacctcattttcccagaacagaagcaccaagaaaattatcaccattattatcatcagagtgcagatccttttttaatagcgagaacatttaaaacctactcttcgaataattttgaaatctacaaaatggcagcatggcccaggagtgtgactggcagtgaaggagctgggaagaccttggatgcaggaaggtcatttaaagcaaaagattaagaagcagcaatgcccctcttgtggcaagagttggcagcgtgcggttggtatgtcaatgcatccaaggtccaagggcctggattgtctgccaaatgcttgggagttgtttgatcaggttgacatgctccaacagcattgtggactgggcccacacctacgctgaggtgaccaatgtctccaactgttggatctgctccaccttccagcagcagctgcggagagtttgccctggaacgcgtatcctgcttctgttaagaactggacatggctagaagcttggggtcccacggacaatgggtgggatgccacagggcgggctttggataggaggcatcacaaaacccatggcaaacctggcccttggctgactcatagtgtccatgatggatggagctggctaatgggagaacacgtggtgcccccattgcaggtatcacaatgtatagagcagcactggggtaaagtcactgtgggatggttgcctactgaggtttgtgcaaacataacatgtgtcaccacaccaagggtgcagtggaacaagcggccttacgaaggccaggcccccatggactttgtgccccctgggagtttatgggtctgtggggacacaggatggccatatctcccagccaactggactggacattgtacctggggttggccctatgtgcctgccactgggcttcccacattgcctagtcgccacataactgggagccactgtgttcctgctttttcccagtgcagcaggccctctagtggttctatcccttagcaatgactatccctggagcaggcgtcattactatagaaaagcaagttgcagcctttgcagaccacacagctc

SEQ ID NO: 461495 - DNA, 1495 bp, Homo sapiens
tcttgaagaatgacagtggattatcgtaagcttaaccaagtggtgagtccaattgcagctgctgtaccagatgtggttttattgcttgagcaaattaacacatctcctgatacctggtatgcagccattgacttggcaaatgcctttttctccattcctgtccataaggcccaacagaagcaatttgccttcagctggcaaggccagcaatatacctttactgtcctacctcaggggtatatcagctctctggctttgtgtcataatcttattcgaagagaccttgatggctttttgcttctgcaaaatatcacactgctggtccattatgttgatgacattatgctgattggatccaaactacaccccgtttctaggacatctctgaaggacagcagtgaagggaaatcttcccagtgggcagaacttcaagcagtgcacctggtcgtgcactttgcaggtaggaacactgtcaccaggacacataacgacaattccattaaactggaagttaagattgacacccggacactttgggctcctcctacctttaagtctatgaagcctaagaagggagttacagtgttggctggggtgattgaccccggctatcaagatgaaatcagtctactactccacaatggagatgctgagggctctgtttacctggtgacacccaaaattctatggagacaacaatgacaacagaattaccacagagaactagaaaatgaaactcagctgaaaaacggccacctaagatggaagaagccatgagatgagtaagcgttgcctactcacaaggttgcaaactgtccttcacttacgattatcccccaacgccccctcctaaatctgatcaatcgcatggaacttgatggttacaaaagacagagctaacaactagcgtaagtgcaccttcttctttgacatgaccttgaactaagtccaaatgagcaatgaacagctgaagtctctcaactgaaaagatcaggacagagagtgctctccaaagcctgtgacccacccatgcctgctctaggtcactgtatgagtctctagctctcacatacaggattgaaatgccatagctcagaattagtgacaacataatctggcctttatttgccaattgccccttatttcttactacctcacaatacaaattctcccctccaacaatggctataatatagccattttctgtactacttaagaaatagaattatagactaatagacttggaaagaacttgaaagattatctaattcaagatcctcactttacagacaaggaaactaatgaatagagaagaagaggacttcatgaaatccccagaattagaaatctctctttctcgtccttctccttctagctgtaaggatactatgcccatagctgaatgtggggaaactaagcagcattgccccatgtccacggtccaggtctgcctcaggcacagccagctccaatgccattgagagaagagatctca

SEQ ID NO: 461496 - DNA, 1222 bp, Homo sapiens
ccagtgtccaagatttctatcatgttgatgcagtggattgctgaatcatatggcaaaaaaagtaaatattttaacttcataagaaattgccaagccatttccaaagtggctgaatcattttacattcccaccagtgatgtttgtttctcccgacaaaagttcccagcctctagcatcagagcagcctttgctggagtcatagaagccatcactagagaatacaccaaatgtattcaatttgaaggcatcatcacctccctcggccaatcacagaagccacagagcattgcatcccctgcactctgtgggggcaaaagcaagttggaggaccatcctggattcatggggagaagaccaaacaagtgtgagtgctggaaaggagacttccctgtgggccagctttggagatgagtgaccacattctccattaccatttgctccacgtggttcagaaccacatgattatttaaccaaagctcgggttgactacacttcaactaactggaacctactgtaacggatccaggaggcccacaggtctgaacaaacacattgtggtcttccaactggtacctggtttctgctcctggatttaccaagtgactcctcctgtgactctggaagccttgaaaaacttggcatcattccttcctctgtagattaacaataactttacccatcttctttcccacaactatggaaaggctctgaaaaaaaacagaaatcataactttgtacctaatttgtgattcctcgtggaaggaggtaaagttctctgggaaaattagagattgcacggtctttcaaatactaataatcataatctcaacaatctctttgctatattaaaaaacttacaggaatttagaatgcctcaaactggaaacaaatgtccatcaacaggaatgtagattcatacaatggaatattcaagcataaaaagtatgaactactaatacataaaacaacatggacaaatctcaaaaacatcatgttgaatgaaagaagccagactcataacagtactcattatataattccattcctacgaaagccaaatacagatcttcaggaaaagttctctacatataaccaatttatctatgttagtggtacattgaggaggtgtccagagacaaagagacaagacagcaaatgaatggacaagatgctgtgagggagtaggattcagaagaatgtcccagagcacaacacagcctgg

SEQ ID NO: 461497 - DNA, 2416 bp, Homo sapiens
gtttgagcaacagagcaaaggccagtgtggaggaagaaaggaaattgttttactcttgtccaaactgtcttcactatttagaggtcatagaggaacaagaagtgactgagagcagtcatggctctttgagcctaaacccccgagactttggaaaagtgaagtgtgatgaaaagatggaattaggaccttagtctcctgccctacttgtcgggtgctgttgccactcatctaagctgccactggtttggagctcacatttttattttttttgagacaaagtctcattcttgtctgccaggctggagtgcaatgttgcgatctctgctcactgcaacctccgcctcccgggagaatcgcttgaacctggaaggtggaggttgtagtgagccaagatcacgccactgcactccagctgggtgacagagggagactccatctcaaacaaaaacaaaaacaaaacaaacaaacaaaaaataaataaaaaaaacttaaataaaacggggctctatgagagtcccatctgcaccccttctagctggtccccacccctgaggaagtgtttccccagcggacctattttctggcccttgaggaagtggttccccagaggaagtggtagcccagtgggtctagttcctggcctcccaggaagtggttccccagcaggcctgtttcctggccttggaggaagtggttccccagtggacctgtttcctggttccccctgggaagtggttcctcagcgggcctgtttcctggccctggaggaagtggttccccagtggacctgtttcctggttccccctggtaagtggttcctcagcaggcctgtttcctggccctggaggaagtggttccccaatgggcctgtttcctggcccccaaggaggtggttccccctgggaagtggttcctcagcaggcttgtttactggcccctaaggaagtggttccccagtggcctgtttcctgaccaccaaggaagtggttccccagcaggcctgtttcctggcccccgaggaagtggttcccatgaggacgtgtttccccagcaggcctgtttcctggccctggaggaactggttcccctgaggaagtggttccccagtgggcctgtttcctggctccctgagctgcattttgtaaatgtagtgactggttttgttgagtctttgcagttgagttttcatagaaacaaccacacttttcacactgttttaaatgggctgagaacatacacaactggctggtgagggcagctgcgctcaggcatgaggcagagtgtggggccgtgagcagcgcacacacactgcctgctgcagacgccgggccgggggcttcacagagaggataggagaggggaatgtacaccagcaattacaatacagggctgtgagaggttagaacgggtgctatggaagcaggaggaagaggtaccagagccacttgcggggcaggatcagggaacgcttcctggaggaaatgaaattatcaccaaacagatcatcactgtgaccacctaccttcatgatcaccatcatcaccattgatgtcatcatcatcatgctcactgtcatcaatatcactatctcctttaccatcattgccatcatcatgctgtcatcatgactgtcctgtcatcttcactgtcctcattaccatcaccacctgcaccatcaccatcatcaccatcatcgttgctgtcatcatcaccattattgtcaccatcatcatcacttcccacctccttctcaatatcaccatcagcttcaccatcaccatcagcatcagcaccgttgtcatcagtaccaccactagcatcatggcagctagcatgcttgaccaccttctgtgtgcctggcaccatgcaaagctctttgcacacattgtctcatttaatttccaccgtgaccctatgaagccaagttgttattctcactttagaggtgaagaaaatgaggatcctaaaggttacacagtttgaccaaggtcacagaaacaattctaactagtagggatgataatagcaggcgtctttgtcttaattctgacttaaatgggaatgtctttagtgtttcacatttctctgcttaaggagtgttaaatgcaactaaatcttattttgatgtttcagagtcattggtaatacataattgaaaaacattctgtcatacagtcataccatcagcaatcagtggagcttacttatctgttttacttgaaggttccaagttttatttttctcactcatgctctctcttttgcattgctgactcactgagactttccttgtttctcttctcttgctcccaagctgtctattgtcggtaatttctgttgtttttctcctttttcattttataaaccattgttttaattgaggccataatttgaggacgtggaaaacatttcaaata

SEQ ID NO: 461498 - DNA, 13114 bp, Homo sapiens
  misc_feature (12493)..(12495): n is a, c, g, or t
ccagacgttccgccccacgtcgcatgcgccccgggaacgcgtggggcggagcttccggaggccccgccctgctgccgaccctttggagcggagggtgaagcctccggatgccagtccctcatcgctggcccggtcgcgctgtggcgaagggggcggagcttgcaacccgccccgcccccccttgccccgtccggcccggacggggtgcattgtgctctaaagccctcggcggggcccgcactgcagcgccagcgtccgagcgggcggccgagctcccggagcggcctggcccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctggggcctgtggctcggggcgctggcggaggggcccgggggcggctgcggggccttgcgagcccccctgcctctgcggcctagcgcccggcgccgcctgccgcgtcaactgctcgggccgcggtccgcggcctgcggacgctcggtcccgcgctgcgcatccccgcggacgccacagcgctaacggcgatggcaaaagcagatggagacgtgaaaaagtacgggagcaagcgaggggctctggccctgacccacggccactcactcctcagagacgtctcccacaacctgctccgggcgctggacgttgggctcctggcgaacctctcggcgctggcagagctacctggtccccaacacctgcccctgccctgcagaaacctgagtgggaacccgtttgagtgtgactgtggcctggcgtggctgccgcaatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccgggcccccggcacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttggggctgccctgcctgtgccctgcggctgcttgcacaacgggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtctcagcgcccgctttgagaatgtctgccctgccctggtggccaccttcgtgcccgcctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccagttccagacccctcggtggcccaggtgctggtggagcacaatgtcacgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcgggcagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctacaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacaggccacgtcgccccttgttctcggcctgcagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagtaaaggcctcgttccatggtcccactccgtggaaggcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcaggactggtggagggtctgcggaaggtcctgctgccggcctggtgtgcctccctggcccacgggctcagcctgctcctggtggctgtggctgtggctgtctcaggcagcgccaccttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcgggggctctggccatggatggcccacgtgctgctgccctacgtccacgggaaccagtccagcccagagctggggcccccacggctgcggcagagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtacgggcatccggagctctggccatggatggcccacgtgctgctgccctacgtccacgggaaccagtccagcccagagctggggcccccacggctgcggcaggtgggagctccctcccctgccctctccggggtggccgcagtcaccagccaggagcccaccctcactcctccggcccccgctggcctaggcggcttccacagcccctcagccacgcctgcactcgcgcgcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcgttttttttccgccctcctgaaccgtgccccccacaggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcacgtgagctccgcagcccgtggcctggcggcctcgctgctcttcctgcttttggtcaagggctgcaagaagacagatttctcgtccgcagctgcccagcacgtacgcttcgtgcgccagtggtccgtctttggcaagacattatgccgagctctgccagagctcctgggggtcaccttgggcctggtggtgctcggggtagcctacgcccagctggccatcctgnnnctccagcagctgatgggctgagcgtgatcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccttttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagggagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcag

SEQ ID NO: 461499 - DNA, 644 bp, Homo sapiens
ctcattttgatccctctgcaggctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgatccctccctgaagatgcttctcaggctcccatgagaaaacaatctatacttatcttccgtgaataaacaagtgtcactctacctaccacatttctctgaatcactactgccacttctgttcatcagaagctccactggaacacaggtctcctcattcctacctgggtatactttccactcagccacatgcccttctaccagaggaaggagggaaggacagagccaaagcttctctggac

SEQ ID NO: 461500 - DNA, 1141 bp, Homo sapiens
gagcccctcttgcaggcaaagggaagcagttggaagagaaaatgaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactctacctaccacatttctctgaatcactactgccacttctgttcatcagaagctccactggaacacaggtctcctcattcctacctgggtatactttccactcagccacatgcccttctaccagaggaaggagggaaggacagagccaaagcttctctggac

SEQ ID NO: 461501 - DNA, 848 bp, Homo sapiens
ctcattttgatccctctgcaggctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctctgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactctacctaccacatttctctgaatcactactgccacttctgttcatcagaagctccactggaacacaggtctcctcattcctacctgggtatactttccactcagccacatgcccttctaccagaggaaggagggaaggacagagccaaagcttctctggac

SEQ ID NO: 461502 - DNA, 1271 bp, Homo sapiens
gacactgtgaagggtatgatgtcatcgttcacaggtgcagtcctggatgtacacgcagtttccacggaaatgctgtcatttggcaagagagctttctatcactgtttttatgccctgactgtatcactagaaaaacatggaagtctctaccttggtgcagaagaaagggttcaagcagctcagaaggacactcctgctttaagtacagaaaactgcatggaagtgatggacttgtatgatctcactgttcctctcccaggaagctcccagaacctctgccctacaagtgagctgggattgccaccttcctactgtgaccacacctggtggaaggaaagagggagctctctggggtattgtatcaggacgctgattccattcatgaaacggagcctcaacacctttcaaaggagaccaaaggccccacctcctgccaccgtcacgatggagttgagattccaacatatgccttgtggggggtcataacccttcagtcaacaggaggactttatgtcagtcaatggatttcatttactgtgtgttctcagaataattttccttgatagtacaggttgggtttctataatttttaccagattaggttgtctctttggaaatcttgaagtttctcacaccatcacactggtaatgagataactctatttatattcgtgattgaagcttcctcattagggccataagcatttggaatgttcttctcttaaatcatttgccgtgatggaataaacttgtcccccctcatcagtattatcatttgttcagaaatacactttttatattttaatattgcaaatccacctttcctttatctttctttaacatggtgtctttctttatgttttaaaatttgtaactgattatgtttaaattttagggtaattttagattttaaggcaagccccctagagtaaggtgtgttctcatgtacaactttccagggttcccatacactgatccacactctaccaaggctgggtctctctccggccatctacggggctcactctctgaacagtgttctgctatccactgtctagtctgtgatctccacacttcttggcctgtctgggatctcagctccttttcctcagcttcaaatctacctggttcctcttcagcactgtggcctggaaactctctttaaaaagtagcaaagcatgcgttcatcagagggctccttttgtatattttccccacctcagcaatcactgtccttgttatttgatgtaaaataccttaaaatcatgttt

SEQ ID NO: 461503 - DNA, 962 bp, Homo sapiens
ctcttatagatagatttagggcaaaggatgaggtctcactatgttgcttaggctggagtgcagtagctagtcacaaacacaatcatggaaactggactgcaattacatgcgtggagtccttattccaaccgttcaaatttttctttgataaactattatgacttaaaagcattaactaataatacaaaggtgcttaaaagctccagagtcagtattgtgttctggggaaccaaacatgttacttttcacaaaatcgtcatggcaactgactcctccttcgcctgctccccaggggtgtccggcgactccagtcactccctggccaccgccagcaggagtaactcggcgctgagctgcgggtacgctctgggcgtggcggacgcggcaggctctgcaggcggcgccttgtggcagagggaaggcatcgctcaccgccgctgccgatgggttcatggatctgtcctgagaggaggacgaggtgtctccaatgccaagcttcggcagcagaagcagcagccacagcaaactgaacaacccacatggatttgacatcccctcatgatcatcctcatgatcatcccctcatgagaaattccaagtttcttcatttgaaatactgctctcttcaagaaaccacaattgtaataatttgtagaatgtattaccattagaaaattaattatgtattatgcacacgtttctgaaatacttcactgcagtaaatagtatatggtgagaattattgtttcctttaacaaaaaactaatgtgggtaaaattatttacataaattcagatgttttggcttcaactgccattctacctcattagcacttccctaacttcataaaaggtatgatttgaaatttttgtttaattcagaatgtattaaaaagaatttttaaaaaatgttataatgtttatattgcaattgaggacatgttcaataaatatcttaaactt

SEQ ID NO: 461504 - DNA, 1212 bp, Homo sapiens
ctcctcaagccccatgagagtgatacagagaggcccagacccggggagggaacagccgtgctggctgcactcgccagggataactatggcttgcttctcattggacgaagtgcccggcggctttcctaagacttctggacctgacaagattcttctagaattcctcagctgccaggtgctctcaccttccctcaatctcaatgagaagcagaataaccagatgtacaaagaatttgaattccagttgtacaagtatagagagacagctgccaaagagctaaaaacagccttgacatatgctgttgtgtccaaaattggtggattcctgacttcactgacctcaagaaggaagccacagaccctcacggccggcagtgctgggggacctggtgctgcctcctcccctgctggcctgggtgctaagatgctcactccctggggccagcgccggccagccgctctgagtgtggggcctgctgagccggcgcccatccagcactcccgctggcccacgagggccatgcgcggccctggttcctgccctgtggccagagtgggcactgaggccaaggaggcactgagagcaagtgagggctgccagcacgctgtcacctctcactgtggagacaagatcggtgaacaggtgatctctgaaccatctggaatttaattgttgatgggagttacagacctagtttgatttctttctaaatgaccacctggctgtctgagcaccattaatcacaatgcttgggtctatttctggaccttctgttccatttcactggtctgtctattcctgcttcagtaccacactgttttaattatagagactttatagtatgtctgaatatttggtagaggtagacctctctcatagcttttctttcgcaggtattcctagctcttcttacatttttatccttccgtatgaatgtgtgtatcagtttaggctctagaaaaaatgttttggcattttactagaatcgcactaagtttattaattaacttgaggagaactgacatatttatgatattgagtcatcttttccaagaacaaaagatgacttggcttatttgggtctacttctgtgtctttcaggagtgttaatgttttcctcatacagactttgttgctcttgtaaatgggttttctctacattacatcctctacttgattatcatttatgtttatgacagttactgatttcc

SEQ ID NO: 461505 - DNA, 368 bp, Homo sapiens
tgcctggctgtgtttgatgtttttagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 461506 - DNA, 480 bp, Homo sapiens
cgctcacgctccagaaccccagccagacgtgcccgctcacgctctagaaccccagctagacgcagtggtcgctcacgctccagaacaccagccaggagagggaggtctcggtctagggcaccaagacgaggaagatcccgcagtagaagcttagttagacgcggaagatctcactctagaacacctcaaagaagaggcagatctggctcatcttcagagcggaaaaacaaatccagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccatccacctcaacctgtcgacagtctgggatcctctagtcat

SEQ ID NO: 461507 - DNA, 404 bp, Homo sapiens
  misc_feature (9)..(9): n is a, c, g, or t
  misc_feature (20)..(20): n is a, c, g, or t
cgcggcccncgcgacacggntgcgagagacgacagaaggggggagcagttccgaaatgccacactggtcaatgaggctgacaagctccgggcagccctggcctgcagcaaagagttgtggatcctgaacaggctctggtgtagctggacctgggtcttttcaaacatccagctgggcaccccctcaagcccttggatgagggtccccacctcccaccatgtgcctcatatgccattacctggatgcagtaaagaagagccacccttgggcagggtgtggtggctcatacctgtaatcccagcactttggaagactgaggtggatggatcacctgaggtcaggagttcgagaccagcctggccaacatggagaaaccccgtctctactaaaaatactaaaaatac

SEQ ID NO: 461508 - DNA, 2635 bp, Homo sapiens
ggtgccagagctgggcagaagctgggagcctgggcagctgctcctcactggcagtgaccacaccgccatctctcaccacctctggatctttaattgcagctacagaatccacataaaatgcttaaagtagtgcctggcacatgttatgagcagccctactcagcaaggcactgaagaagcgaagggcatgacaagtcatcctttgccttggccaaggctacagatgaaggaaggcaagaagttggaggcattctagtgctgtgctgagtgctttcagagtgtatggttggggctagtgaggtatggggacatggagcagggaataagggagattcaagttcatggagaggtcagggagggcttcccggaggaggtgagctgagtcttagaggaagagtaggaatcagacaggctaatgtggcagagaaaagaattccaggcaaagggaatagcaagtgccagggatagaggtaggagagagtgtggggactgagtgtagctagggcagaggtgtgcccaagagataaagctggtccccaagggccccaggggctgcaggagacagtggatggggcaggtgggaaatgagcaacctattggccctgacctctggctgctgaaacaaagtatgagaggagtgagggaggagggggacccacagggaggaaggggcactaagccccagaaagagacagcagcactgggggtctgggtgaatgggaggggaagggagaggaggagctgcctgtggttcccacttgggtgacaggtgtgatggagtgtggaggagggcaaggaggaggaacagcctggattgctgagtgtgagcggcctggcagctggcctggccgtgcagagcctagggaggcagggcaggttctgaggtttggggtggcatgtcatcttcatgggttgatggtctgtgaagccactggcagcccagttcctcatcccttccttccccacccttagcgtctccccagcagcttgagggtgaggtggtgccaggctgcgggggcagctgctcttgcaagaggtccaggggtcagcccatggcctctgagcagccctgcccaggtctcgtccctctccacagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 461509 - DNA, 2446 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaaaaaaaaaaaaaaaaaaaaaaaaaaaaaggggggggcgcgcgcgctaaaagaatacccccccgcgggggcggcgcccacaaggtttcgccgcacgcacacccacggtgttttgtgtggcaaacacgggcggcgccaccaataagggggcgcggcacgaaaattataaacacaaagaagcgacgggcgcgcgcgggttaaacaacaccggttcggcagctgggggaaaaaccggcgcggcagcgcgggggcgcaccactggggaggagagagggcgacaccccttatacgccccgagcgggggcggggcgcacaccctgtggcgggcacaacaaacattccccctacagaggagaagatattaaaagacgcgcttacgagggcggacagcatatatcaaaaattttagaaaggagggtaaataagtggggggtgtagaaaaatgagggggggataaaatatgctctagggagttgtggagaaaaatttggtggctacacaggcgagattatggattgtagaaaaaaaattttattaaccaggggag

SEQ ID NO: 461510 - DNA, 2231 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaaaaaaaaaaaaaaaaaaaaaaaaaaaaaaaaaaaaaaaacacaaaaaaaaacacaaaaaaaaaaaaaaaaaaaaaaaaaaaaaaaaaacaaaagggcgcggcgggccgccccccacccccccccgccgcggcgccccccccccccccccgacgcgtgttgttgtttacaagagcaggggccaccccggcaagaggagggtgttgcttttacttaatagtcatgcgccacgggcggtgggtcgtttacaacaacccactggtggtggacagacaaaaacaacacgcacctgccaggcggtatctcgtctgtttagggcaagccgccactccctgcttttgctggcgagagagcacaataatgggaggacagccgtagtcctgcctcagagagtctgtgtgagtcgctgcgggggactatcacaacctctagcgggggtgtatgagatgcgcaaccccgccgtcctgacg

SEQ ID NO: 461511 - DNA, 1770 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtcatcccagcggctggtgcagggcctccattcctggagcccgaggcaccagtgtcctcccctcaaggacaaagtctccgcccacgtttctttggctgggagcaggctagttctggaggcccaggttgctgaggaccttcagcccttgcccttaatgcaacccccctaggcctgcatggaccctgcgcccaggcccgggggttgctcaggggcccagtcagggccgagagcagagcttttatgacagtgacggcttgttggggctccctgccct

SEQ ID NO: 461512 - DNA, 1299 bp, Homo sapiens
  misc_feature (1119)..(1119): n is a, c, g, or t
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccaaaaaaaaaaacaaaaaaaaaaaaaaaaattttgtgtggggggcacttgggccacgaaaggaaaagttttataaaaacacatttctgggtgggggacgcgggccccagggttaggtgcagtttgcacacgtggcgcccataccgctggtgctcccctgagaggganaacccgcggccccgtagaacataagtcgctgtgggtttccttcacccacattaaaaaaaagggcggcggggggagaagcggacgtggtcgtgaaaccaaaatcccgagaggggattcggaagcacataagggtcctccaaagagggttcaggaggaccgaaattaattagcgcgcggggc

SEQ ID NO: 461513 - DNA, 947 bp, Homo sapiens
  misc_feature (417)..(417): n is a, c, g, or t
  misc_feature (422)..(422): n is a, c, g, or t
  misc_feature (426)..(426): n is a, c, g, or t
  misc_feature (442)..(443): n is a, c, g, or t
  misc_feature (473)..(473): n is a, c, g, or t
  misc_feature (484)..(484): n is a, c, g, or t
  misc_feature (714)..(714): n is a, c, g, or t
  misc_feature (774)..(774): n is a, c, g, or t
  misc_feature (781)..(782): n is a, c, g, or t
  misc_feature (784)..(785): n is a, c, g, or t
  misc_feature (788)..(788): n is a, c, g, or t
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaaggtaatcnagccntgcnttatgggcacagcccnnccccatactcctagctcctggcccatgttntgagggctgtnatgggccattccattcaacaaatggacttgacttctttggttccaatctccactttgctgctgcttcgctgtgtgactctgggcaagttaccatcccgctctggtctctagttcctcttctataaaatgaggctaagagcaatactccattagttatgtgaggattaaaggagagaatcctaggccaggcatggtggctcatgcctgtaatcccagcactttgggaggcngaggcgacctggggtcaggagttcgagaccagcctgacaaacatggagaaaccccatttntactaannanncanaattagccaggtgtggtggtgcatgcctgtaatcccagctactctggaggctggggcaggagaattgcttgaacctgggaggcagaggttgcagtgagccaagatcgcaccattgcactccagcctgggcaacaagagcgaaactctgtctcaaaaaaa

SEQ ID NO: 461514 - DNA, 431 bp, Homo sapiens
cctctctactctcttgattggattgatattataataaaatattacacctgaaggccagaatctccctgagccaggttttgcctgggattgtcattttgcaacctctgtgttcacaaggactttgcccgggagcaaggtggacgtcctgcctatccctggaacagggtgtggtcccatccatggggactctaaagtgggagtggaaagccagaggcctgagagagctcctcctcaaggctgttagggacccagccggactgagaatcttttgtttttctggcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagca

SEQ ID NO: 461515 - DNA, 3065 bp, Homo sapiens
ggtgccagagctgggcagaagctgggagcctgggcagctgctcctcactggcagtgaccacaccgccatctctcaccacctctggatctttaattgcagctacagaatccacataaaatgcttaaagtagtgcctggcacatgttatgagcagccctactcagcaaggcactgaagaagcgaagggcatgacaagtcatcctttgccttggccaaggctacagatgaaggaaggcaagaagttggaggcattctagtgctgtgctgagtgctttcagagtgtatggttggggctagtgaggtatggggacatggagcagggaataagggagattcaagttcatggagaggtcagggagggcttcccggaggaggtgagctgagtcttagaggaagagtaggaatcagacaggctaatgtggcagagaaaagaattccaggcaaagggaatagcaagtgccagggatagaggtaggagagagtgtggggactgagtgtagctagggcagaggtgtgcccaagagataaagctggtccccaagggccccaggggctgcaggagacagtggatggggcaggtgggaaatgagcaacctattggccctgacctctggctgctgaaacaaagtatgagaggagtgagggaggagggggacccacagggaggaaggggcactaagccccagaaagagacagcagcactgggggtctgggtgaatgggaggggaagggagaggaggagctgcctgtggttcccacttgggtgacaggtgtgatggagtgtggaggagggcaaggaggaggaacagcctggattgctgagtgtgagcggcctggcagctggcctggccgtgcagagcctagggaggcagggcaggttctgaggtttggggtggcatgtcatcttcatgggttgatggtctgtgaagccactggcagcccagttcctcatcccttccttccccacccttagcgtctccccagcagcttgagggtgaggtggtgccaggctgcgggggcagctgctcttgcaagaggtccaggggtcagcccatggcctctgagcagccctgcccaggtctcgtccctctccacagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgagtgagactcattactaaactaaagcaggagtgggtcaatacagcagctggggaggccgggtgggggaagctgggtgcatgcggagcaccgtggagtctgggaccccagagcacaggaggggagacgtgcccagcctgccggcccttcctgcaggtgccctgcgcctgtgcctccatgtctgcctgcaggactccgggctccttttcatgctctattgactgagctagctgggtggtttgcagggctccttttattcctattctgatggcagctggagctgctgggtggtggggagctgtggacccagtgctcccgcaccctaacatccaatacttcggaatgtaactgtgactgtattagaagaaagatccctaaaagagtaaatacagttaaatgggtcccttagggtaggtcctgatccaacatgact

SEQ ID NO: 461516 - DNA, 1951 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 461517 - DNA, 2445 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatgaaaaaaaaaaaaaaaaaaaaaaaaaaaaaaaaaaaaaaaaaaaaaaaaaaaaaaaaaaaaaaaaaacacaaaaaaaaacacaaaaaaaaaaaaaaaaaaaaaaaaaaaaaaaaaacaaaagggcgcggcgggccgccccccacccccccccgccgcggcgccccccccccccccccgacgcgtgttgttgtttacaagagcaggggccaccccggcaagaggagggtgttgcttttacttaatagtcatgcgccacgggcggtgggtcgtttacaacaacccactggtggtggacagacaaaaacaacacgcacctgccaggcggtatctcgtctgtttagggcaagccgccactccctgcttttgctggcgagagagcacaataatgggaggacagccgtagtcctgcctcagagagtctgtgtgagtcgctgcgggggactatcacaacctctagcgggggtgtatgagatgcgcaaccccgccgtcctgacg

SEQ ID NO: 461518 - DNA, 1825 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtcagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 461519 - DNA, 1254 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 461520 - DNA, 880 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaaggtacggaggtgcatggtagggttcaagaaccagttcgccccagtgcctgaaagtgcactattaggaagttaatagactattgcctactggactcctggtcagggaaccttcaaaagcaaaacaaaaaacc

SEQ ID NO: 461521 - DNA, 680 bp, Homo sapiens
cttctgagcgccccctcacccccaccccagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagaactactggccgaagctggatcacgcccttagtgtctggctggatataatagtacagggactggccgaagctggatca

SEQ ID NO: 461522 - DNA, 633 bp, Homo sapiens
gacaccatcagcagggagagcacctgtgtttttgtgaagaattatgccgagaagatcgatgattccagatggaaaaaatggaaatgcttcatccatgtgctagttcagcctgtgagatgctggtgagcccacctccaggcactcacggactccccacccattgagtgtggcctggatttagtgactcaatcaaacgtgacagagtgctggggtgtcattttcaagactgggttatgtgaagactgcagcctccatctggggtgctctctcttggattgcttgctcagggatgtggggagagctgctgtgctgggaggctgcccatgtgagttgacttggatgtgaaccttctgtggcctgccaatagccacgtgtttgtgtggacactgctgtcatttctcttgggaagatactgaggagtcagattgctggatcccgtgaagaatgtgcacctgggattggctcttgcttcctaaggaacctcaaaaaagctgcaacctattggagacttttgattcagcatcaaggatatgcgtgagactttggttcttttctgttgggacacagttgattctgactgtcttaaagttaggcttttctaaagatttagactaataaattatttgaatggga

SEQ ID NO: 461523 - DNA, 299 bp, Homo sapiens
accctgctaagccacacacagcttcctggcccacagaaactatgaaataataaccatttcttatataagcctccaagttttgggagtaatattttgcacagtgatggatcactaatacaagccagtcatcagttgaaagacactgaatttatttccagttttatgtgattatgaataatgtcaccatatgcatttgcatacaggtgtttgtgtggacactgctgtcatttctcttgggaagatactgaggagtcagattgctggatcccgtgaagaatgtatgttgaatgttataaaaa

SEQ ID NO: 461524 - DNA, 338 bp, Homo sapiens
ctcaatcaaacgtgacagagtgctggggtgtcattttcaagactgggttatgtgaagactgcagcctccatctggggtgctctctcttggattgcttgctcagggatgtggggagagctgctgtgctgggaggctgcccatgtgagttgacttggatgtgaaccttctgtggcctgccaatagccacgtgagtgaccttgaaaatggatcagccttcactcaagtctcaagatgactgtggtcttggctgacagcttgattgctgtctcatgggggaccttaaaccaaaggcaccctgctaagccacacacagcttcctggcccacagaaactatgaa

SEQ ID NO: 461525 - DNA, 1251 bp, Homo sapiens
tcttttttttttttttttttttttttaccagcacaatattttatttagctgccggcaatagtgtgcttcaaaaagttgagcttttggtccattatgataccaaactatttcaaaaagccattcttgcccaaatgacagcaaatcaaggtcttctgaaactgcgtccaccctactctaccctccagatagccagctcttctgctcaaagaaaacatgcagatgttcaggggaaggaattccccaaagctgatctccatggcataatggatatgctgtggacactccatagaacctgctgctgctccttcaaacttgggtgggcaaaagtcgaaaaggctttggccttgattgaaggtttagcaggaagaagcagcctctgttctccctctcctcctgaattggaggctgctcagagcactgaaatctgcgctcgcatcagtaaaaggatggcaattaaaaacactggcagctctgcggaagctcctgtagtcatctctccaaatcgctactggccttcccctccaaatgaaattgccatcctcactttgtggcagtccaagggtggcaaggtgggaggatgggatggaatgaagcatatgaaacgacttaatcaggacaatatatactattcagttgatgtggacactaaaagcccagccatggccacgatgccatacagccacatattgaccataccgacactgcttcatccatgtgctagttcagcctgtgagatgctggtgagcccacctccaggcactcacggactccccacccattgagtgtggcctggatttagtgactcaatcaaacgtgacagagtgctggggtgtcattttcaagactgggttatgtgaagactgcagcctccatctggggtgctctctcttggattgcttgctcagggatgtggggagagctgctgtgctgggaggctgcccatgtgagttgacttggatgtgaaccttctgtggcctgccaatagccacgtgtttgtgtggacactgctgtcatttctcttgggaagatactgaggagtcagattgctggatcccgtgaagaatgtgcacctgggattggctcttgcttcctaaggaacctcaaaaaagctgcaacctattggagacttttgattcagcatcaaggatatgcgtgagactttggttcttttctgttgggacacagttgattctgactgtcttaaagttaggcttttctaaagatttagactaataaattatttgaatggga

SEQ ID NO: 461526 - DNA, 2072 bp, Homo sapiens
atcaagcctggtatttttgggtttcaggttctgcggctccctgagacctgcagattcctggtctccgggtccctgggtcccggacgtgtccatcaaggcgtccattagggccatcacctaatggacaagcatcagggtaaggggggaggtgctattgggggggggtccctcagagaatcagccctagctctgtgtgggggcaaatacggcctccccacctccctccctcccaggagacactggcctgagcataagtctcgagggtctgccctgtactaagcaagcgcttaatcagaggatgtggcttctgcgggagagcttcaaagggtgccctacttgcccctcttggtaaccatgacgtcatggaaatgggaggggaccgccccagcccccaaacacctggagggaagtgggagactttttccacttcctgttctacttgtggctactgactcaatgtctgacctgtttattaattgcaaaatatagctctatgtgtgctacccagagaggcctcaggcctgtgtgtctctgtgtgaaaggaggcctgcactccccacccctcgccgcgttgcccaggtggccttgacacagacgcagggcgctggtggtcctgcagccttccggcagccagaatgacagcactgggtctccatgtgcttgctcccccagactcatcccagtcagaagctcgtcttcccacacatggctcacggaggtttaacagcctcggacatgagggaaggttcttgctgaatcaaggatctcctggatttagacggaaatttctcaggggtggagctgagcctgctttccggatgtccccctacctgcccgggccttgtcatcgtgcctccctgcttgggtgtgggtgggtccatagcccctgctgcatcaccttgcatagatctgtgggcggccttgggggaccagtgactgctgggctttgctgcctgagggcactgggctggcaggctccacaggctccacaggctcccgcagcctccacaggctccacaggctcccgcagacctccacaggcctccacaggcctccacaggctcccgcaggcctccacaggctccacaggctccacaggctcccgcagacctccacaggctcccgcagcctccacaggctccacaggctccacaggctcccgcagcctccacaggcctccacagcgtcccgcagacctccacaggcctccacaggcctccacaggctcccgcgggcctccacaggcctccacaggctcccgcgggcctccacaggcctccacaggctcccgcgggcctcctgcaggtctcctgcagtccgggtctcctctgaggttcttggaggggtggtatggtcctaccacgtgcgagagtgaccctgctgtgatggaggtctgagccctttccctttggtgttatttaaggggattgtatttaggtgagagatggggcagcttagaaagaactggggattctgtgactcccgtcagtagggctgaccaggagaagggacactggttcttaattctacaggggtcacagaatcagaggtgcagggagtgggaggtagcctccagtcctacccgacatttcgtgagagctcgaggcctctactctcctcggtcaaatctctgggcttgtggggagacagctcatctccttttttcctcattctcacatccgggatggtgggaacataaagtcctgctggggtcacagcttcctctcaaccttgctcctggtgtcagcttgggcacctcaaagggctggcgtggggctggatcaggcagcagagtggtgggtggtccccagccacgaatttgtgagacaatgcacagtttcagtggaaacccagtctgagaggagaggcaaaggaaatgctcctggagggcaggagacagtgggtggcattttggggacacttgctgtgtggtccctgtctgccgcaggtcactgccacccatgtgtgtgggctcctgttatgggtggtcccgtggcgtggcatgagagtgggagaggaggggtccaagctggtaggtgggttttcctggcccttagcatagcctgctaagc

SEQ ID NO: 461527 - DNA, 1975 bp, Homo sapiens
atcaagcctggtatttttgggtttcaggttctgcggctccctgagacctgcagattcctggtctccgggtccctgggtcccggacgtgtccatcaaggcgtccattagggccatcacctaatggacaagcatcagggagacactggcctgagcataagtctcgagggtctgccctgtactaagcaagcgcttaatcagaggatgtggcttctgcgggagagcttcaaagggtgccctacttgcccctcttggtaaccatgacgtcatggaaatgggaggggaccgccccagcccccaaacacctggagggaagtgggagactttttccacttcctgttctacttgtggctactgactcaatgtctgacctgtttattaattgcaaaatatagctctatgtgtgctacccagagaggcctcaggcctgtgtgtctctgtgtgaaaggaggcctgcactccccacccctcgccgcgttgcccaggtggccttgacacagacgcagggcgctggtggtcctgcagccttccggcagccagaatgacagcactgggtctccatgtgcttgctcccccagactcatcccagtcagaagctcgtcttcccacacatggctcacggaggtttaacagcctcggacatgagggaaggttcttgctgaatcaaggatctcctggatttagacggaaatttctcaggggtggagctgagcctgctttccggatgtccccctacctgcccgggccttgtcatcgtgcctccctgcttgggtgtgggtgggtccatagcccctgctgcatcaccttgcatagatctgtgggcggccttgggggaccagtgactgctgggctttgctgcctgagggcactgggctggcaggctccacaggctccacaggctcccgcagcctccacaggctccacaggctcccgcagacctccacaggcctccacaggcctccacaggctcccgcaggcctccacaggctccacaggctccacaggctcccgcagacctccacaggctcccgcagcctccacaggctccacaggctccacaggctcccgcagcctccacaggcctccacagcgtcccgcagacctccacaggcctccacaggcctccacaggctcccgcgggcctccacaggcctccacaggctcccgcgggcctccacaggcctccacaggctcccgcgggcctcctgcaggtctcctgcagtccgggtctcctctgaggttcttggaggggtggtatggtcctaccacgtgcgagagtgaccctgctgtgatggaggtctgagccctttccctttggtgttatttaaggggattgtatttaggtgagagatggggcagcttagaaagaactggggattctgtgactcccgtcagtagggctgaccaggagaagggacactggttcttaattctacaggggtcacagaatcagaggtgcagggagtgggaggtagcctccagtcctacccgacatttcgtgagagctcgaggcctctactctcctcggtcaaatctctgggcttgtggggagacagctcatctccttttttcctcattctcacatccgggatggtgggaacataaagtcctgctggggtcacagcttcctctcaaccttgctcctggtgtcagcttgggcacctcaaagggctggcgtggggctggatcaggcagcagagtggtgggtggtccccagccacgaatttgtgagacaatgcacagtttcagtggaaacccagtctgagaggagaggcaaaggaaatgctcctggagggcaggagacagtgggtggcattttggggacacttgctgtgtggtccctgtctgccgcaggtcactgccacccatgtgtgtgggctcctgttatgggtggtcccgtggcgtggcatgagagtgggagaggaggggtccaagctggtaggtgggttttcctggcccttagcatagcctgctaagc

SEQ ID NO: 461528 - DNA, 4952 bp, Homo sapiens
  misc_feature (1)..(1): n is a, c, g, or t
  misc_feature (5)..(5): n is a, c, g, or t
  misc_feature (9)..(9): n is a, c, g, or t
  misc_feature (11)..(11): n is a, c, g, or t
ncacntggngnagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccaggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttcccaaaagcagtgttgttattgaatctggccccttcccgaggggataaaaggcagagccctgtcccctcggttcccaggggcaccttgatgagtttgtgaggagtctgtgaagaccagtaggcctcaggaaaagtgtgtgctgggcggaccagtaggcctcaggaaaagtgtgtgctgggcggaccaggaaacagaggggcagccttgcttcctgcccccaccccccagtgggtttggaactgaagccaatagtggctcagaggctgggtctcaggctgaagctggtctccacactgactggacacagcccctgccctcccagaacctgtggctgctcctcctaaaggcaggagcgctagcctggaggccaacctctgcctggcatgggcctcaaagaccagaatcccaccctccacctggcagtaggggcccagtgagaggaagggcaggaccctgttctctgggacatgggctagtaacaggcttcaccttgccccacccctgagttcctaaacctaccattctgctttgactcaggagatgcgagatgacccaacacacagcctcaggggccaggagcttcctgagaaggctggggccctgtgcttcctagtgtggggacacatctgcacgaggcccaggaagtgcaggccccaggcccctttgagctcccccaggcagggatccctgcctcctggggtctgacacagggcccaggcaggatgggatctggctccaaagcctgtgcttcctgtacctctccctccaggcgcctctctcaacctgtcttagagagaccagccagtttggaaactagccaggggctttcaggagaaccccggctctggtccttatctttggctgtgtgtgtgtgtgtataggaagggcaggtagttcaggggaaggtgtggtggggggtgggggcgggatctgcctccagcccaagtagagaagcgcagaggtgctgaatatcagagcaggatggactcttcaagtcctgccccatcagactagaggataaactgaggccccaggaagggaaaggacttccccaaagtcagcccctggtaggtatcagagattggagttaccaggagagggaaggccgagagggagcaggaggcttctagaaggcccaccacaggcagcctg

SEQ ID NO: 461529 - DNA, 1724 bp, Homo sapiens
attatgtgaattatatatctcctgcaaatatcgaatacttgagtcatgtgttaaactcgatgcttcatatttcataatctcttctaacattctcctggacttcaaagtagcagcgtctatcatatttggttttgatgattcatcaggattataagtgagttggattgcttttatcagctgtttgacttctgatgttttgttttcaacttgatgtaagatgtcttccaaagactgtagatccttgtctactttggtttgataagtagacaggaaatctgcaatgccacaggtagttggacaataactaccgaatctttcatctaagatgcagcagttgtctctggtagcaacatatgctacacatgttgaagagagaaataaaagagcatagaagtagagaattaaattccgggggtgcaaggaccaactcatgatgtctgagtgcccggagctccgagccttgcggggccattgtgaggttgggggaagacctggccgtggagctacaagcttgtgcggatgtcaggggacattactgttgctaataaagtccaaagtggccaatgcctttcccaaaagcagtgttgttattgaatctggccccttcccgaggggataaaaggcagagccctgtcccctcggttcccaggggcaccttgatgagtttgtgaggagtctgtgaagaccagtaggcctcaggaaaagtgtgtgctgggcggaccagtaggcctcaggaaaagtgtgtgctgggcggaccaggaaacagaggggcagccttgcttcctgcccccaccccccagtgggtttggaactgaagccaatagtggctcagaggctgggtctcaggctgaagctggtctccacactgactggacacagcccctgccctcccagaacctgtggctgctcctcctaaaggcaggagcgctagcctggaggccaacctctgcctggcatgggcctcaaagaccagaatcccaccctccacctggcagtaggggcccagtgagaggaagggcaggaccctgttctctgggacatgggctagtaacaggcttcaccttgccccacccctgagttcctaaacctaccattctgctttgactcaggagatgcgagatgacccaacacacagcctcaggggccaggagcttcctgagaaggctggggccctgtgcttcctagtgtggggacacatctgcacgaggcccaggaagtgcaggccccaggcccctttgagctcccccaggcagggatccctgcctcctggggtctgacacagggcccaggcaggatgggatctggctccaaagcctgtgcttcctgtacctctccctccaggcgcctctctcaacctgtcttagagagaccagccagtttggaaactagccaggggctttcaggagaaccccggctctggtccttatctttggctgtgtgtgtgtgtgtataggaagggcaggtagttcaggggaaggtgtggtggggggtgggggcgggatctgcctccagcccaagtagagaagcgcagaggtgctgaatatcagagcaggatggactcttcaagtcctgccccatcagactagaggataaactgaggccccaggaagggaaaggacttccccaaagtcagcccctggtaggtatcagagattggagttaccaggagagggaaggccgagagggagcaggaggcttctagaaggcccaccacaggcagcctg

SEQ ID NO: 461530 - DNA, 3803 bp, Homo sapiens
  misc_feature (1)..(1): n is a, c, g, or t
  misc_feature (5)..(5): n is a, c, g, or t
  misc_feature (9)..(9): n is a, c, g, or t
  misc_feature (11)..(11): n is a, c, g, or t
ncacntggngnagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccaggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagagcccccgcgtacaggtccagctgcggagggagagagccttgtgtgggactgttattcccagggctccagcaagccactccctgggtgacctcgggcaaggccctctctgggcctcggtggcctgtggataaggaggggagacccccactcgcctgcctgcctgcatcacggggccattgtgaggttgggggaagacctggccgtggagctacaagcttgtgcggatgtcaggggacattactgttgctaataaagtccaaagtggccaatgcctttccca

SEQ ID NO: 461531 - DNA, 2952 bp, Homo sapiens
  misc_feature (1)..(1): n is a, c, g, or t
  misc_feature (5)..(5): n is a, c, g, or t
  misc_feature (9)..(9): n is a, c, g, or t
  misc_feature (11)..(11): n is a, c, g, or t
  misc_feature (2777)..(2777): n is a, c, g, or t
  misc_feature (2800)..(2800): n is a, c, g, or t
  misc_feature (2847)..(2847): n is a, c, g, or t
  misc_feature (2858)..(2858): n is a, c, g, or t
  misc_feature (2876)..(2876): n is a, c, g, or t
  misc_feature (2879)..(2879): n is a, c, g, or t
  misc_feature (2890)..(2890): n is a, c, g, or t
  misc_feature (2895)..(2895): n is a, c, g, or t
  misc_feature (2898)..(2898): n is a, c, g, or t
  misc_feature (2908)..(2908): n is a, c, g, or t
  misc_feature (2914)..(2914): n is a, c, g, or t
  misc_feature (2931)..(2932): n is a, c, g, or t
  misc_feature (2938)..(2941): n is a, c, g, or t
  misc_feature (2950)..(2950): n is a, c, g, or t
ncacntggngnagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctcctcgtgccgaattcggcacgaggtgtattaagcttttcaaacaatggaggggatgggccctngtgtcctgacgggagccaggtcngcctgagagctgtgccgctcctctgtcttgtcagtggaggtgcctgngtggtgagcangtctcaggcctcttgtcnctncccagtggctncaggnctnatagtggcangggcangatgaggctgcacccgnntggagnnnntttgttctngg

SEQ ID NO: 461532 - DNA, 2897 bp, Homo sapiens
  misc_feature (1)..(1): n is a, c, g, or t
  misc_feature (5)..(5): n is a, c, g, or t
  misc_feature (9)..(9): n is a, c, g, or t
  misc_feature (11)..(11): n is a, c, g, or t
ncacntggngnagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctgtcgacgcggccgcgaatttagtagtagtaggcggccgc

SEQ ID NO: 461533 - DNA, 3663 bp, Homo sapiens
  misc_feature (1)..(1): n is a, c, g, or t
  misc_feature (5)..(5): n is a, c, g, or t
  misc_feature (9)..(9): n is a, c, g, or t
  misc_feature (11)..(11): n is a, c, g, or t
ncacntggngnagccagacccggagcctggcagcgacatcctgggctacatcaatatcatcgaccccaacatctggaacccccagcccagccagatgaaccgcatcaagatccgtgacacctcccaggccagcgcccagcaccagctgtggaagcagagccaggacagcaggccccgtccagagccttgccctcccccagagcccagtgccccccaggacggtgtcccagctgagaacggcctcccccagggggaccctgagccattgccccccgtgcccaagccccggacagtccctgtggcagatgtactagcccgggacagcagtgatattggctgggtcctggagctccccaaagaggaagctccccagaatgggacagaccataggctacccaggatggcaggcccaggccacgccccactccagcggcagctatctgtgacccaggatgaccccgagagcctcggggtggggctccccaatgggctggatggggtggaagaagaagatgatgacgactacgtaaccctcagtgaccaggacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctagcagcatgtcccagcctggagccacaccttctgaggccccagcccagactcatgacgcggagggcagacaggccgcctgggcctaccagagcccactgggacggcaggaaggtgggatgggcgggagacgttggcactcacctggtcggtgcaccagtaccaggtggccatgatggtcaggccaaaggtcatcccggtccacggcaggtcccctgtgtgggggtctcgaaacatgtgcatggcgtctgtacgtggcaggtggcaggtggtgttggcaatggtcctggagggaatggcctgggcgtaggctgcctccagctgcccgtaaccaccgatctggtcaaaagctggaggggtcagggtggaacagggacagtttggtggttgcggggccctgactccctgggctcccccctgccttcatctcacaagaaacttcctgatgcatcaaacttgagttttttccacctcatctttcccagtgtttggaaaggtgtgagggtagagggttgtttttttttttaaggtgtatttgaatgactattttattcgtatttaaaataatactattaagtaagcattttgcacatgggcaccccagtgtcccgctggcccagcaggagtcactgttggcctctggacactcatcggccttgggcaagtggttctcagccaggtttccgattgtcgattcaaggaagcaaaagtaatttttcttgacatttgaggaccttcctgaggcttctaaagtgttcatcctgatcacctgaagggtgtgattttagcagagctgagagtggctggtggtgatgtggccccaccccctgaggcacagagaagagggagacaggtccagagagggatggggcctccaccaagaccatatagaccatctggcgggctcaagccggggctttttcctctccagtccaaaacacctcactgttcctgtctacctcggggtcagggcccggcatggccaagccctggcccatctgtgtctgtgtcactcccctcccttccagactgggcctggctgctgggatccctctcatgcggtgggtcccagggacactagagcccctggtctgagagggagaagcctggatgtaggaaaacccgtttccaccccaggccctactccctagccttttccaagtgggacatggaagaggcagcctgctgcctggatgctggtctccccagcatcactgttcccatggagctcaggtcaggctctgtattcagaccgagggtttgtgtgaggctcagagcaaatgaacaagtgccattcaagggttagaaactgctcagccacagggtcccagtgtctgagtctggaagagtctttagagatttgttcactctctgagggatcctcctggctctgcttacatacttccagggacggtgagctcacgctctctccgggcagccctgtgagtttcctatctgttccagactagtatcgccaatctctcccagctctcttctttcctccctggcctttgtcctgcaggaggtagcatcacctcttggcattttgtacatgcttttaaacaattggaggagctgcccaggcagttttatggcctcctggttgtgtgccttcacacccgcctacagccccacctcaccatcaagcgctgagccaatgcgggtgtggctggccctgagttcctgagtcagctccttgccaggccagagctggtaacagcggggcagcagggtgggtagcctctaccagccagggcagtccctgaggggccagcaggggggctgactgcctagtggctcaacctcctgaacccacccactcccagcgatgctacccagaaccccaacggcatgaatcctgcacagtgccgggcagtgccagactccaaagggctcgctgtggggacagccccgccatggccacagactctgtcctcacctttgattgtcaggatgacagcccccaccaccatgatgagcgtctgcagggcgtccgtgtagattacagcagccaggccccctgccagtggaagcaaggttgctggagggggccctggccccagggaggagggacacggggaggaacttctggggctcctgctggggccacttcctgggctgctccctcgggcctgtagggggaggtggccttctgacccctttacacgtcccctgggtggacctccctgctgcaggcaccatacctgcgatggtgtacagggctgtgatgccgagcgtgaggatggtggagaggtagaagttccagcccaggcagatgtgcacaaacagaacccccactcgcctgcctgcctgcatcacggggccattgtgaggttgggggaagacctggccgtggagctacaagcttgtgcggatgtcaggggacattactgttgctaataaagtccaaagtggccaatgcctttccca

SEQ ID NO: 461534 - DNA, 1299 bp, Homo sapiens
cgctaacgcatggtgtcggagggaggcccacttgctgaacagcagggagcgatggcgcagaacgtgtatggtccgggagtccggataggcaactggaatgaggatgtctacctggaggaggagctcatgaaagacttcttagagaagagagacaaggggaaacttctcatacagagaagtagaagactaaaacagaatctcttgagaccgatgcaactttccgtaactgaagatggctatattcattacggtgacaaagtgatgcttgtgaatcctgatgatcctgacacagaagctgatgtgtttctgcgtggggacctgagcctgtgtatgactccagatgaaattcagtcccatctgaaagacgaattagaggtaccctgtggcctgagcgcagttcaagccaagaccccaattggcagaaacacttttatcattttgagtgtacacagagatgccactggtcaagtccttagatatgggcaggacttttgcctggggataacaggaggatttgacaacaaaatgttgtatttgtcaagtgaccacaggaccctcctgaaatcgtctaagaggtcttggctccaggaagtgtacctaacagatgaggtctcccatgtgaactgctggcaggctgccttccctgacccccagttacgcctggaatatgaaggcttccccgtcccggcaaatgctaaaattctcatcaatcactgtcacacaaatcggggactggcagcccaccggcatcttttcttaagcacctattttggaaaggaggctgaggttgtagctcacacatacctggattcacatagagttgagaaaccaaggaaccactggatgttggttactgggaatcccagggatgcctcgtcctccatgttggatctgcccaaaccacccacagaggacactcgagccatggagcaggccatgggccttgacacgcaattagaatatgtggtctctaacatgacttccagatatattaataatctgcttttagcatctgagctggactttgatggaaacttagaatattggcagggggagactggctctccaggatgcagccgctgtatggacctgtgtacagtgactttggcacacagcacctctgcagcgacctccagtggtgcacaatcacaaattgtggagagcatcctgcgtgctgtgtgcagtcattcattatacagaaaatgccactgagtcacttgctgcaacgatgcctgcacagctttgtcctgagtcatggacaatgggctcctcccagctctaaggttcactttctttcaa

SEQ ID NO: 461535 - DNA, 587 bp, Homo sapiens
  misc_feature (1)..(2): n is a, c, g, or t
  misc_feature (5)..(6): n is a, c, g, or t
  misc_feature (9)..(10): n is a, c, g, or t
  misc_feature (13)..(14): n is a, c, g, or t
  misc_feature (17)..(17): n is a, c, g, or t
  misc_feature (169)..(169): n is a, c, g, or t
  misc_feature (172)..(172): n is a, c, g, or t
  misc_feature (174)..(175): n is a, c, g, or t
  misc_feature (177)..(179): n is a, c, g, or t
  misc_feature (181)..(183): n is a, c, g, or t
nnttnnctnnacnntcnagtctagacaagacatgccttcagaggatgttttatctttacaagtctctctcgttaatcttgacatgaaatgttaccctgatcgtgtggactatattgataaagttctagaaacagcagcggagatattcaataagctcaaccttgaacantangnnannntnnnttactttgactatgagtccagaaagagcatgagttgttatgtgttaagtagtgttctggattataacacagaaattgtctctcaagaccaggtggattccataatgaatttggtatccacgttgattcaagatcagccagatcaacctgtagaagaccctgatccagaagattttgctgatgagcagagcgttgtgggcccttcattcatctgctgcgctctgaggaccctgaccagcagtacttggactgtggtattgtgctctgtgagctatgtgatctgtacagagtgactgtctgagtattttaactgattcccttatgtttctgtgtgagattgtgtgtgtctgtgcgttttcattttctattacataccaaatgtagtagttaggaagtatgcctttt

SEQ ID NO: 461536 - DNA, 684 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (11)..(11): n is a, c, g, or t
  misc_feature (14)..(15): n is a, c, g, or t
tntntncnttntannagaagccctagacccacttttcatggatccagacttggcatatggaacttatacaggaagctgtggtcatgtaatgcacgcagtgtgctggcagaagtattttgaagctgtacagctgagctctcagcagcgcattcatgttgacctttttgacttggaaagtggagaatatctttgccctctttgcaaatctctgtgcaatactgtgatccccattattcctttgcaacctcaaaagataaacagtgagaatgcagatgctcttgctcaacttttgaccctggcacggtggatacagactgttctggccagaatatcaggttataatataagacatgctaaaggagaaaacccaattcctattttctttaatcaaggaatgggagattctactttggagttccattccatcctgagttttggcgttgagtcttcgattaaatattcaaatagcatcaaggaaatggttattctctttgccacaacaatttatagaattggattgaaagtgccacctgatgaaagggatcctcgagtccccatgctgacctggagcacctgcgctttcactatccaggcaattggtaaagctcataagaaaactggtttggaggtttcagtgagaattaactttgatcattcattcttaaattctttttttcactgatg

SEQ ID NO: 461537 - DNA, 1178 bp, Homo sapiens
gaacgcatttgcacaaattcagctgccaccctgctcacaggtaaggttataacatatcactaagcctggtacttaatgatgtgactctctgatcctgtttgtgccctgccctcaagaagcattgtgacatcactgggctaagcaacaaggtaatcttgcttatgtgtgtcttctgtctaggccatgtgcacagggggcattgagaaatatctctggaccaatcacctaaaagatgtgactctcctcacttgcctggactctgctcagaatagagatttcgacacatcagtgggttcaacacctaggtgatgcggctcttccttcttttctgggctcttccatcagagaagattgtgacattttctgagcccagcactcaagtgaggtgacttgtctccctggactctccccacagacagcattgtgaaatatctttgggatcatcacctaggttactgggatctcaatgtagatgttatgtccagacagaggctgctgtgagctgaatcgtctgcttcccaaaattcctatgttgacaccttaacccccagcacctaagaatgtgactatatttggagatagcatcatcacagagtctcagggatgtctttatcagcagtatgaaaatgaaccaattcatcccacttcactgtttgaagaaaaactgctggctctatggggtcttcaatttactgaatgattcctagatgcctggccctaattcactcaagagtcaagaaaggtgccaccttatggtgctcactgggcggttgtggatgtctaacctcagtgctagtcacacagaacctgaagccaggctggctgctcctgtaaatggcatggaatcccagggaatatcctgcattctcagtgtccagctgtctgatgccacagttgtttatgatgatcgaggacaactacgtttttctgaggagacttaccacctcatggctgaggcattcacaaaaaatagctcacgttatgttttgcttatttgcaaattgggctctgatcctcgtgcaacatggagtttaggtgacttgcttctcccaggcacagagtcccatagtctatctctgacaaatatttctggatcagtctttcaagtgaagctcttctgccaatgtcatgagtgaacacatttctcaaagcctcctcagggacctaagccatttccc

SEQ ID NO: 461538 - DNA, 876 bp, Homo sapiens
gaacgcatttgcacaaattcagctgccaccctgctcacaggtaaggttataacatatcactaagcctggtacttaatgatgtgactctctgatcctgtttgtgccctgccctcaagaagcattgtgacatcactgggctaagcaacaaggttactgggatctcaatgtagatgttatgtccagacagaggctgctgtgagctgaatcgtctgcttcccaaaattcctatgttgacaccttaacccccagcacctaagaatgtgactatatttggagatagcatcatcacagagtctcagggatgtctttatcagcagtatgaaaatgaaccaattcatcccacttcactgtttgaagaaaaactgctggctctatggggtcttcaatttactgaatgattcctagatgcctggccctaattcactcaagagtcaagaaaggtgccaccttatggtgctcactgggcggttgtggatgtctaacctcagtgctagtcacacagaacctgaagccaggctggctgctcctgtaaatggcatggaatcccagggaatatcctgcattctcagtgtccagctgtctgatgccacagttgtttatgatgatcgaggacaactacgtttttctgaggagacttaccacctcatggctgaggcattcacaaaaaatagctcacgttatgttttgcttatttgcaaattgggctctgatcctcgtgcaacatggagtttaggtgacttgcttctcccaggcacagagtcccatagtctatctctgacaaatatttctggatcagtctttcaagtgaagctcttctgccaatgtcatgagtgaacacatttctcaaagcctcctcagggacctaagccatttccc

SEQ ID NO: 461539 - DNA, 911 bp, Homo sapiens
attctcagggacaggtaccagctgggatgttggcagcagccgctcccctgcaaggagaacctcccacttcctgtcccgcacacctgcctcattggaaagtgacgcacccactgtttggcctcggcagcctgatgtttctcatcacacaggaagacggtcatgctacaggaagacctcggactttgcatccagcagatggttgttctagagattgtcagaccgagaccacgccacacacccagaaggcacccaagtcacagagcctgatattgttcctggagcgccattgcatcatccttgaccacaagatctgcgtcattggatttgtctcaaaaacttgggactctggagataaaacctcattgcaaggctacctttgccactgtatcttagcagcttttgaagcaaagcatttcaatatttagacactgtgtttctaatgggtactgggatcaaaataataaaaactcagtctgcaaagggagaagaatagaaaccagcagatttattatttcacagaatgttcctctcctctcaggaatccttgcaaagtaggaaaattgaacccagtgattgttttcaagatagctttatgttaatactcaatttaaccaattaaagaaatcgacataaaatcaactaaccccatatgtggttttttttttttgtttttgtttttgttttttttggcccctgacttttgtggagacccatgagatgcttggtcctgagcctaacggatgcaggggcctggctgggacccagctgggaagctgatgctgttctccagcctgacccaccttcctagaaagacagctcaggattcatttctgcccagggctttcgtcgtgcatgagaagtcccttctgccttctattttctctgctccaggaaacctctctccgcagccc

SEQ ID NO: 461540 - DNA, 1170 bp, Homo sapiens
attctcagggacaggtaccagctgggatgttggcagcagccgctcccctgcaaggagaacctcccacttcctgtcccgcacacctgcctcattggaaagtgacgcacccactgtttggcctcggcagcctgatgtttctcatcacacaggaagacggtcatgctacaggaagacctcggactttgcatccagcagatgtgagttcaaattccagctttgtaatttgcaagctcagaggtggatttgctgggaagctaaacaagcttacctgcagagcccccagcttgcatgggcccctcccaagaccttaacctcattttgtattcataattttgtagtcttttcccttcaaaaggcagcccaaatttaaaagcattaagccccacaagacctgagtccacctaggaggtgggagatatcccttgcagcatgagaataataattaccacctcgtagggttgttctagagattgtcagaccgagaccacgccacacacccagaaggcacccaagtcacagagcctgatattgttcctggagcgccattgcatcatccttgaccacaagatctgcgtcattggatttgtctcaaaaacttgggactctggagataaaacctcattgcaaggctacctttgccactgtatcttagcagcttttgaagcaaagcatttcaatatttagacactgtgtttctaatgggtactgggatcaaaataataaaaactcagtctgcaaagggagaagaatagaaaccagcagatttattatttcacagaatgttcctctcctctcaggaatccttgcaaagtaggaaaattgaacccagtgattgttttcaagatagctttatgttaatactcaatttaaccaattaaagaaatcgacataaaatcaactaaccccatatgtggttttttttttttgtttttgtttttgttttttttggcccctgacttttgtggagacccatgagatgcttggtcctgagcctaacggatgcaggggcctggctgggacccagctgggaagctgatgctgttctccagcctgacccaccttcctagaaagacagctcaggattcatttctgcccagggctttcgtcgtgcatgagaagtcccttctgccttctattttctctgctccaggaaacctctctccgcagccc

SEQ ID NO: 461541 - DNA, 821 bp, Homo sapiens
gtgtccgtctgctcgtgggcctggagggcattaatattacactcacagagcgccacacccccactttcctgtctgaatccgcttagttgcgaggtctccgaccgcgggcagccccatgagcccgcctcaccccacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatgggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgccc

SEQ ID NO: 461542 - DNA, 2997 bp, Homo sapiens
cagcgccgagcagagagggtcagggtttttgacgttcctcgccagctgcacaaacctcccggagcaagtgtgagtgtgggtgagagtgcgcgcgcgcgcacgggctggctgcgcttggcacgcttggtggcccagggtcccggggcccggggtcccgtctggcggcccgggattaccgtgacgtcacattgagcctctggccaccttggactgggacacctccggagcctcacagccccgcgccgcgccgcgcctcacctcgccaccacgcgcctttgggaacccgcatcttcttccttcccctgcccatccatgggcccttctgtcttccggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccagtttctggcgtcggcaagttccagcaccacatgctgcgaatctacccaacgctctgtctcagatgtggcatcaggctccaccccagcgcccgctctctgctgcgcaccctacgatagtcgactgctgggcagtgcgcgaccggagctgggcgccgccttgggcatctatggagcaccctatgcggccgctgcagctgcccagagctaccctggctacctgccctatagcccagagcccccctcactgtatggggcactgaatccacagtatgaatttaaggaggctgcagggagttttacatccagcctggcacaaccaggagcctattatccctatgagcggactctggggcagtaccaatatgaacggtatggcgcagtggaattgagtggcgccggtcgccgaaagaacgcgacccgggagaccaccagtacactcaaggcctggctcaacgagcaccgcaaaaacccctaccccactaagggtgagaagatcatgctggccatcatcaccaagatgaccctcacccaggtgtccacctggaaagagaacaaaatgacatgggcgcccaagaacaaaggtggggaggagaggaaggcagagggaggagaggaggactcactaggctgcctaactgctgacaccaaagaagttactgctagccaggaggcccgggggctccggctgagtgacctggaagacctggaggaagaggaggaggaggaggaggaagctgaagacgaggaggtagtggccacagctggggacaggctgacggagttccgaaagggcgcgcagtcactgcctgggccgtgcgctgcagctcgagagggccgattggagcgcagggagtgcggcctggctgcgccccgcttctccttcaatgacccttccggatcggaagaagctgacttcctctcggcggagacaggcagccctaggttgaccatgcactacccatgcttggagaaaccgcgcatctggtctctggcgcacaccgcgacagccagcgctgttgaaggtgcacccccagcccgcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggttagcgcaatggctgcgatttgcgaaagaatcttggaaatgggccccacgtttcgaattcatctccaggttaagaagctgccagaccttgccagggaccaggagctctcactttgcctaagagacagacacacagaaaccctcctagcagctgtccttgcacgcagagctggggtggtgggccgacttgaaccttagcagtccccacgggagatggcagggcaccttggggaaggccaagtgggaggctgggaggctgccccacccaccgactctaccaagtctctcttcctcctgtggattcagcaaggcttcctctcctgctcacccctgtctctcacctccaccaaccccactcactttgtaacttcatcactgacccggccaataaggaccctgtgcgtcttctccccctcctaagcccttgtgtccttaaaaataatcagtccgaacccatgtagtgtggcctatctttgccagaggtgcttgagaggtcggtgtgcaggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggggagagggatccttagaatcagagagtcaacacttggagatgggaagctgaagatcagattggagaagggaccccactaaactcagttcatgtggctgagcagggtctgggatccagagggtgggggttagggggaatctcaccttcacac

SEQ ID NO: 461543 - DNA, 1040 bp, Homo sapiens
aaccgaaagccaattgaataatgagtgacatgtgcatcagccaattggagggaggcaaagtcccgcccgctgggtggttgatgtacagcaacaggaagctggaaggggaggggcttagccgaagagtgcttttgtattggtcgaggttgaccttccacccacctctaacccagaggatgaatgatagatctgccctgaagccaatcagaagtccttagggtgaggcccacaaatgccccagaaatagcatatacattgcgccctaagtccagtctcgcccaggtgtggcaggagcttttacctgctcttcggcagtagccggctgccactcaaccccatgcctggtgagtggaaagccatcaaccttttatttagtccctctctcgttgtcgcctggggaggggcgactttgtacagtgaggcactggggtccggcaccatagtgggagttggggttgtttacgcgacacttctaaggggattttcacaatcggttaagcccccgttaatcctcacatggttattgcggcgacccccatagcccacggtcccaaacgtgtgcatctgaatcatccgaagctctttctaaaggcaggctcccctggccgcctctcctaatccgactcggtacttcacggggcgtgcctagaatctgcattttagcaagggcctcgcgtggacagaattgcacgcttgagtttgagaagtactgcttggcctctgccccacttacccttaccttcttgagatgaggtaaagcacttggtaggcactaggcgggtaggtttatctttgctcccaagtctcttccgagaacttgggaaggctgcctagcttagtgagggaatccattctggcttcagaccagtctgggtttgaaacctacacatcccactaacttaggcagggtaccgaaactccctgagcttcatgtcctcatcagtaaaacgaggttaatcacacctacaccttagcgcgatggcttaaaaaaaaaaaaaaaacaaacaaaaaaaaacatagtccatcaagagaaatacatt

SEQ ID NO: 461544 - DNA, 1485 bp, Homo sapiens
aaccgaaagccaattgaataatgagtgacatgtgcatcagccaattggagggaggcaaagtcccgcccgctgggtggttgatgtacagcaacaggaagctggaaggggaggggcttagccgaagagtgcttttgtattggtcgaggttgaccttccacccacctctaacccagaggatgaatgatagatctgccctgaagccaatcagaagtccttagggtgaggcccacaaatgccccagaaatagcatatacattgcgccctaagtccagtctcgcccaggtgtggcaggagcttttacctgctcttcggcagtagccggctgccactcaaccccatgcctgggttgtcctcatctaatccgtcagtaccagacagtgaacatctctcccccaggatgctgagggagggtcctggagggaaggatgtggaactacagcctctgctctcaagaagctcagatctgggcagggaacatcacataccagggctgtctgtcgggggggtggagggctgggggagggatagcattaggggaaatacctaatgtaaatgacaagttgatgggtgcagcaaaccaacatggcacatgtatacctatgtaacaaatctgcatgttgtgcacgtgtaccctagaacttaaagtataattaaaaaaaaaaaaagcttcagatccctcctggagcctcctatgaaaccacgtggcataactgggttcttccttctttgctccttctttctacccccagtctccctggggtgggatctgtggagcctcaggaagaaagggcagggccccagcagcatcttctctctgcctctgcccctcccctgcactcccctgctccccacctttcccgaccccattgaccacagctccatgtggtgcccagtctgcttctccatgtttgccaggaaggtgaggagcctggctccacccttcctggaaagacatgagaaggagagagtggccttcatgctgaaggtggggagaggcccccccggggaagcagggagcctgggagccagccccaggaatgcaaggagatggcagatggcaaatacttgccctgaggccctggagagggatgagggtggtaagaagctgggagaagaggaggaggaggcagatgccaggccagagtttctgagaagagaagaagccgggtgggagaggggaaatgacaaagctgcccccctggtggtggcaggggcccggaaaagggggctgagggggagctgagaaagcagtcagtgaagacttgggagaggcagctgtctaggcccctctcccctgtggaatggctcctgctgaccacaggtttgggcaggtggagggggcagagtcctcaactttagggaaaagtattaatggtagacacacagtcccaccctaatgggggctctctggcctcagagagctacaatatactggaaaagatgcagcctgtgttcttgcgaagcccccagtctaacgtaagagat

SEQ ID NO: 461545 - DNA, 1544 bp, Homo sapiens
aaccgaaagccaattgaataatgagtgacatgtgcatcagccaattggagggaggcaaagtcccgcccgctgggtggttgatgtacagcaacaggaagctggaaggggaggggcttagccgaagagtgcttttgtattggtcgaggttgaccttccacccacctctaacccagaggatgaatgatagatctgccctgaagccaatcagaagtccttagggtgaggcccacaaatgccccagaaatagcatatacattgcgccctaagtccagtctcgcccaggtgtggcaggagcttttacctgctcttcggcagtagccggctgccactcaaccccatgcctgactgagctgtggtagaaggattgaggccagcacagaggaggatcagcaggaaatgtaagggttgtcctcatctaatccgtcagtaccagacagtgaacatctctcccccaggatgctgagggagggtcctggagggaaggatgtggaactacagcctctgctctcaagaagctcagatctgggcagggaacatcacataccagggctgtctgtcgggggggtggagggctgggggagggatagcattaggggaaatacctaatgtaaatgacaagttgatgggtgcagcaaaccaacatggcacatgtatacctatgtaacaaatctgcatgttgtgcacgtgtaccctagaacttaaagtataattaaaaaaaaaaaaagcttcagatccctcctggagcctcctatgaaaccacgtggcataactgggttcttccttctttgctccttctttctacccccagtctccctggggtgggatctgtggagcctcaggaagaaagggcagggccccagcagcatcttctctctgcctctgcccctcccctgcactcccctgctccccacctttcccgaccccattgaccacagctccatgtggtgcccagtctgcttctccatgtttgccaggaaggtgaggagcctggctccacccttcctggaaagacatgagaaggagagagtggccttcatgctgaaggtggggagaggcccccccggggaagcagggagcctgggagccagccccaggaatgcaaggagatggcagatggcaaatacttgccctgaggccctggagagggatgagggtggtaagaagctgggagaagaggaggaggaggcagatgccaggccagagtttctgagaagagaagaagccgggtgggagaggggaaatgacaaagctgcccccctggtggtggcaggggcccggaaaagggggctgagggggagctgagaaagcagtcagtgaagacttgggagaggcagctgtctaggcccctctcccctgtggaatggctcctgctgaccacaggtttgggcaggtggagggggcagagtcctcaactttagggaaaagtattaatggtagacacacagtcccaccctaatgggggctctctggcctcagagagctacaatatactggaaaagatgcagcctgtgttcttgcgaagcccccagtctaacgtaagagat

SEQ ID NO: 461546 - DNA, 2060 bp, Homo sapiens
  misc_feature (2051)..(2051): n is a, c, g, or t
  misc_feature (2054)..(2054): n is a, c, g, or t
  misc_feature (2056)..(2057): n is a, c, g, or t
acagctacaacgaggagaaagatgaggaccactgcagctcccagtgggcacacctgccagcaaatcaccactgctcccacagatggggcccctgggggaccattctcaggcatttctgacaaatggcagccactgttgagtactgttacaggggttcacagatacaagtggttgaagcagaatgttcaggatctttatccgcagtctccactcctcagtacaattgctgaatttgcccttaaagaagagccagtggatttagaagtctggcagtgtcccgagtcaaattctttatctttatttgaaagggaacctcttactgattgtttaaaggatgttgatttgatcccaccttttaatcggatgctgctggaagtcacctttggcaagctgtatgcttggactgttcagaacattctaaatgttctgatggatgccagtgccaaatttaaagagcttggtatccagccggttcccctgcagaccatcaccagtgagaacccattgggaccgagcctggggagcatcccgcaagcccgcttcctcctgatgatgctcagcatgctcaccctgcagcacagcgcaaacaacctcgacctcctgctcaattccggcacgctggccctcactcagacggcactgcgcctgattgttcttccagatgtagagttattgatttgagatcatcttctgtgaatgcagacttctatagtataattgcccgtcttagccctgcttttggcgcagcacagaagttttggccccagttgtgacaatgttgaggaagatatgaatgcttctgctcaaggtgcttctgccacagttttggaagcaacaaggaaggaaacggctcctgtgcatctccctgtttcagggccagaactggctgccacgatgaagattggaacgagggtcatgagaggtgtggactggaaatggggcgatcagaagctgaacaaactgaaaggaacattcaccccactacaatgatgtttaccagcactattaacttactgcagactctttgtctgcctgccagagttcatgctgagatcatgcagagcgaagccaccaagactttatgcggactgctgcaaatattagtggaaagcggaacgacggacaagacacgcatggaatgagagattgagggcccagggagtcagcgctgggggccgcacgcttgtcgtgtccgggtgtgcatgtgggtgggtgtggatgtgtgtggattcatttcctgtggctgctgtaacaaagtactacaaacttgggggcttacgcagtagaaattctcatgattctggtggttggaagactgagatcaagggtggttccttctggggctgtgagggagaagctgcttcagggctctgccccagcttctggagtttgctggcctctttagcgttcctcggcttgtagaggggtcaccctgatctctgccatcatcttcacatggcattctccctgtgtgtgagtcacctccaaatctccccttttcataaggacatcattcaacctcatcaaactgattacatctgcagcggccctatttccaaacaaggtcacctgccgaggtatggtaggggttagggcttcaacatacaaattttgcaattctgaattcaacccataacactggcttcaaacaacaaatttgttctctcagagttctggagaccagaagtcccaaatccaggtgcgggcagggccatgctccctccacaggctctaggggaaggtccttccttaccttatccagcttctgggagctccaggcttccctggtgtggggacgcattgtgccagtctcagaggcctgcatcttcacatggcccctgcccctgtgttctgcatgtctttttctgtctctgaaaggactctttcattgagcttctttgactctaatccaacatgatgtcacctaaattcttaccttaaggacgtctacagagacctcattaaataagatcatattctgagttccgaatgtatgtgaagttgggggacaggcacagtttaatccataaagtgtttgtgtgtgtggaganttntnnaaa

SEQ ID NO: 461547 - DNA, 585 bp, Homo sapiens
agccttcgggaaagaacatcaagatgaatggagtctgagttcctgacaacatggagcatcatgccagccatgaaccacttctgagacatccctatgagacaaaaataaacttccatgttctttaatttatcattttggagggttttctgttattgccgcaaaacctaatcttaactaatacagacattgtatctgaaattcccaggaaaatccctgtaaacgtgttgcttgccacgaataactggcctctaccagtatcacattccagatgagcagaacagggaaaggattggaagacaagagaggggaggaacacacctcgctctctcctgctattggctgtgcctggctgcaagctagaaatgctgggtccattgcaaatggccacacatctaaggccctaccaccatgggaacagccactgggagataactagcagcttttaccatttgtcatttaattattttaaagttagaaactttttctttttgaatgtctgaaagagaatggcctgagaaatattttggaaaagttaaataaagctgatttgtgactgttaaaaaaaataaaagtacaatcatagta

SEQ ID NO: 461548 - DNA, 509 bp, Homo sapiens
gtaagttgcattcacgtgggaagcacaaagaattaaattcaaaacaatgaaacattagagaaaagcatggagttaaaacacaacagaatcagatgtttactatttctcattttaacactagtgctttgcgggcttctaataaagttgtactccaggaggctaagactgaaaagtgacactagtgaaaagtagcattgaaatagttccttagaaaagttgggtgaatgtggggcaaagatgccactaaactttaattttccatcgacacacaaattcaaagttttccagaactggcaagtaaaatggaagatccactcacaggacacatgcagtgtgtgaggggaatgcttttcagcacttcttgatggatgcacaaataatgccaatgtggtaaatgtctttggtaaatgtgcaatggaatgtagtggttgtgtgaaggaagaattttgttttcagcttcatttttgataaacacaagcagctctggactgtgtgaaaccatggagcac

SEQ ID NO: 461549 - DNA, 2294 bp, Homo sapiens
atgaatgaaaaaaattacacctttagaaaaagagttgttataaaaaagccttggttgcgtctgggggaagtgacagcacagaagagaccagagaatagcctgctggaggagaccctgcactttgaccatgctgtccggatggtgcctgtgattacagaggaaatacctttcaactggaagatatcattaaacacaggaaaagagatcaggaaaatccctgtaaacgtgttgcttgccacgaataactggcctctaccagtatcacattccagatgagcagaacagggaaaggattggaagacaagagaggggaggaacacacctcgctctctcctgctattggctgtgcctggctgcaagctagaaatgctgggtccattgcaaatggccacacatctaaggccctaccaccatgggaacagccactgggagataactagcagcttttaccatttgtcatttaattattttaaagttagaaactttttctttttgaatgtctgaaagagaatggcctgagaaatattttggaaaagttaaataaagctgatttgtgactgttaaaaaaaataaaagtacaatcatagtaaatgggcttttgtcacttattatattttaaacatgtttctagggcagaacataaccgatgaggagttgaaggagaaaaatgccgaactacaagaaaaacttcgacttgtagaatctgaaaagtctgagatccagctcaacgtaaaggaccttaaaaggaagctggaaagggcccagctcctgctgccacaggcgagcagctgcagccccgggggttgtgggagccccatccggctggggccatggtctagggatcatcagcagctgcaggtggaggctgaccgcctgggtaaggagctacagagtgtgtcagcaaagctccaagcccaggtggaagagaacgagttgtggaacctcctgaaccagcaacaagaggagaagatgtggaggcaggaggagaagatacaggagcaggaagagaagatgtgtgagcaggagctgaagataagggagcaggaggagaagatgtggaggcaggaggagaagatgcatgagcaggaagagaagatacgggagcaggaggacaagatgtggaggcaggaggagaagatacgggagcaggaagagaagatacgggagcaggaggagaagatgtggaggcaggaggagaagatacgggagcaggatgagaagatacaggagcaggaggaggagatgtggaggcaggaggagaagatacgggagcaggaggagaagaggcaggagaagatgtggaggcaggagaagaagatgcgcgagcaggatgagaagatacgggagcaggaggaggagatgtggaggcaggaggagaagatacgggagctggaggagatgatgcaagatcaggaggagaagctgcgggaggtggaggagaaaatgcaggaggaggaggaaaagatgcaggagcaggaggagaagatacagaggcaggaggagaagatccaggagcaggaggagaagacgtggaggcaggagaagctgctcaagcaggaagagaagatatgggagcaggaggagaagatgtggaggcaggaggagaagatgtgggaacaggaggagaagatgcaggaacaggaggagaagatgcagaggcaggaggagaagatgcgggagcaggaagtgaggctgtggcagcaggaggagaagatgcaggaacaggaggtgaggctgcaggagctggaggagaggctggggaagctggggcagaaggcggagctcttggggggagcaggcagagaatctggaagccagcgactacctaccctgacgcctatcctgcaggtggagctgaagagccaagaggctcagagtctgcagcagcagcaagaccactaccggggtcacctgcagcagcataactgaaggtgaaaggacagaatcaccatgtgttactggcacagatgcatcggctagtgaagaaagaagacattcaaactagtcccgctctgtcgcccagtctggagtgcagcagcgccatcatagctcactgccacctagaagccggggtgaagcaatcctcctccatcagccttcagagtagctgggactacctgcgcggcccaccacacccggctaatctttgtggtttttgttttgttttccgttctgggtttccgtcgggcgcagtggctcaggcctgcaatcccagcactttggaaggcagaggtgggcggatcacccgaggtcggagaccagcctgaccaacatgaagaaatcccgtctctact

SEQ ID NO: 461550 - DNA, 684 bp, Homo sapiens
agcgggtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaagcctcatgcagtctacaaaatagaacaggagctccaatgagctggacaggggaagtcggctttagaacaaggctgaagaaagtggaaaccaaagaacagaaagaagattg

SEQ ID NO: 461551 - DNA, 524 bp, Homo sapiens
tcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaacttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcatttactgaagtagtttgattggctggctaacttagaattattgtttcttgttttgtactgcaataggggttataattgtaagataaaaatgtgtgtgtgtttaagggaagtaggtggtggttaaaattcttggaaaattttcagaatactttaaaaataaagttccaagttaca

SEQ ID NO: 461552 - DNA, 3311 bp, Homo sapiens
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaa

SEQ ID NO: 461553 - DNA, 3253 bp, Homo sapiens
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggctggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaa

SEQ ID NO: 461554 - DNA, 2263 bp, Homo sapiens
cggtagtgttttgtaaaaaagttaaaatccacctgcaatctgcagccatatatctgccagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagatctaaactgcagaggtagaaagcagaaaacttggcaaatgacagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagccttttgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaa

SEQ ID NO: 461555 - DNA, 3469 bp, Homo sapiens
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaatggttagcatttggtcccacccagatctcaatttgagccggatcttccacaattcccattgttgggcgagggtccctctcggacatggccgatccagggcgtgcaatcactataactgttctgggagtgcccactggcctcaggcttgatcgtttctc

SEQ ID NO: 461556 - DNA, 3207 bp, Homo sapiens
  misc_feature (3204)..(3204): n is a, c, g, or t
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgtataaaaaaaaaataaaantaa

SEQ ID NO: 461557 - DNA, 3081 bp, Homo sapiens
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacacttgcatccagagacctttgcatccagagggg

SEQ ID NO: 461558 - DNA, 2901 bp, Homo sapiens
atttgatacactctcatagttttgtgtcatccattgttagagaagaatgaggcacagtactatagtattgtatgaattgtggtgacagttgtcaaatttgtacagtgaactctgtaacccctcatttcagtctttttaccctcctttcaagttcctcctgggaggaggagaggagagaggcgagtccagtgaggtgtagaaatggaacgtgcaattcctacaacatcgaaagcttagttatgagcattaatacaaccatgtagtagagcaagtgcccaaggtttaaagggaacttggcagtataagaaatattttgggttctctctgctattttatagctttttttgttgaactttcaggggtatgtacatgggcagagaaacacaaaggtacatgtgctggagaatactggacacagtaggaagaagtataggtgtccagaagaaaatctaagaggaatattgtaatttgttaaaaaaaatagttttgagttttaacagcagttagaataaagcatgctgttgacttcactttcaaatttcagtgtaggtaatgactaaaaattactttgaaactttttacagtaatactgtaatagcttaaacagtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctggcttccaggttcaatagagtctcctgcctcagcctcccaagtggctgggattacaggctcatgccaccatgcccggctaattttcacatttttagaagagacgaggtttcaccatgttgaccaggctgatcactaactcctgacctcaaataatccacccacctcagcactttgggaggccaaggctggcggatcacctgaggtcaggggttcgagattagcctggtcaaaatggcaaaaccctgtctccactaaaaatacaaaaaaaccccaaaactgtccaggcatggtggcacacgcctgtggtcccaactactcgggaggtggaggcaggagaatcacttgaacccaggaggtggaggtcgcagtgagccgagatcgtgccactgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatacaggtaataggtatgacgaatgagtacgaaatttgagatcggtatctcgcgtgacgatcgatcgttgtgtgagtgataagagaagagtatacaactgggaagaaagggcagtcttagtatagttatcattgtaatatatgttcttgcagctcttgctccagacaggacgcaggtggtaatctactggctgcacaggattcagatactgtgaggggaatggtacttatagtgatgattacggccagctatcacatggatcagcttcaggttat

SEQ ID NO: 461559 - DNA, 1875 bp, Homo sapiens
agcgggtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcagggacaaataaccatgtaacagtggcaatagaaaattgagtaccacttgttcataactaaccatttgaataagagcaaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattaggaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttat

SEQ ID NO: 461560 - DNA, 374 bp, Homo sapiens
tcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccaggcactttgggaggccaaggctggcggatcacctgaggtcaggggttcgagattagcctggtcaaaatggcaaaaccctgtctccac

SEQ ID NO: 461561 - DNA, 756 bp, Homo sapiens
cgcacctcggcggtctctggttgtttaaagaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcgataggaagcaccacgtgggaaccagagcctttattgtggttcctgtggggaaggcagggtaagcagattttggattggctggctgcaggaattgcagaggactcaggtatcggggctatctctagttgtcttgtacctggtcctgggatgatgaaggcagaggactgctgccttctggagtgtaaaaggcagatagaagaggtggttctcagtgtgggatctggattgtttagtttatgtatgaaagatgtgctcctggctagaaaaataagtctacgctaaatcactgaatcattttttccccttagatctaaactgcagaggtagaaagcagaaaacttggcaaatgacagggtcccagcttttgcttagttgaaaataattcttgaaaagcattacatcctttgctgccttagttaaaaaagagcaca

SEQ ID NO: 461562 - DNA, 3089 bp, Homo sapiens
agcgggtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagccttttgcactccagcctgggcgacgagtgaaactccatctcaaaaatatatatatatatcaattaccaactaaaaacataactccagtttggcagtttgcatattataaggagataaatgttaaaacatacttgactactttcagaaatgttctcctggtactttttgcatttctacattcagataaaaagatttgcatgcacctggctaacgccaagggaacttcatttttttcttcactattatgcactttcatggtatagtctttctcagttcttttaatttttgttatttaacatctttaatagcacagcaaacatcttttcagaaattttcagttaaagcctttgaattacttatctttgatttaatttacagccagcattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataatcctagcctgtgacttaatgttgatgctttgctttgtcttttggctggcctaacctacattgacatgtacacagaacattttaaaactttttttttcaaaagtcataatgaattactttattaataaacaaagtcttgtatttgaa

SEQ ID NO: 461563 - DNA, 1797 bp, Homo sapiens
agcgggtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattaggaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttat

SEQ ID NO: 461564 - DNA, 1357 bp, Homo sapiens
  misc_feature (40)..(40): n is a, c, g, or t
  misc_feature (43)..(44): n is a, c, g, or t
  misc_feature (47)..(47): n is a, c, g, or t
taagaaattactactcacataaattacatttgtgaggtangtnnaangcggccaggttccaagtgtggtgagggatctgagggatttctgggccgccagaatgcattcaggtggagccaagcatccaggttgggtagcagaaactacaatgtatacatgcttctcccaggaagccaggcaggggccatgtaagaggctggtggacaggcatgcctacaggatagacatgtcccaatcctgcgggctggagcccatgcgagggtctgcagtctttgttccggatggggaactactgcttcagctggttacccaggtgccccgatggggaaaggaaggaaatggtgagaatcttcagcacagcggatcacatcaccctggaagagaccagtcctgcctgcgcatagcacaagcagccgcaggctagaggcagtcatgtcaggcctcctccatacagcatctctcctgcttttttttcaaacggccctaatcacttaatttggtcatcttccctgtcacaatggggcacctggcgctatagacacttgggaaacacacagatctgggatcctacagtgtccaggtgaagacgccgggagtcagagaggaaagtcttttgaagcctccaaaaggaatgcacaggaccccacttgaagaggtggcgtgcccagtggcggatacaggccccacacatcgcagcagtaaacagggactccacggtgtccagctctccagcctggggtttctcatcacccagtgattccaaaagaaacgatctacaatggcatgactaagttccagaaacaaataaacaaaatactgagggaagcccattggtcactttgattcttcaaaggtgacaattgtccctccctgaaatcttatgagtgcatgaacagactattctaatgtaaatgaaattcacactaaaactgattgaaagatgattctgtttccaaggtactttgtattctcaaattgcatctgcttaccctggccccctcaaaatggaagagtgatgactatttgtcttcgtaacactgtggggacacagagccttaaatggaagagtgtcaaaagcaacattccataaagggctgtcacttccaattttcaagcgaggttggaaaccaaccatgatgtatgaaacactgttggccaaagtgcacaattagtaatacaaaatgaataatataaactattgtaaatatgtgtggacatcgtggcaatttggacatcaaaaacactgccaaattcagaaagaggaagctgtaaactcatggctgttaggaagcttaacttctgtgtactagaacctatcaaaattaaatttctccatgtcaatccgtccaaacaaaca

SEQ ID NO: 461565 - DNA, 1297 bp, Homo sapiens
gatccctgatacggcctctaccctggagcctgtcctgacaccttaattgctccttcctcttgaatggtccttgtggaccagcttcttaactggccccttctctccacgctgctgacggcagtgattccaggctcccattgctgcatgtcttaagtccagggcactgagtggatgatgcaggctgtgcacagccgctgcacaccctggtgccacggaacctgcacgaaccccatggagtgtgctcgggtgttccacacaggtggggcaaggctggtgctgtgtggaaagaactgggagaggctagagaacctatatgatgccttgatcagcgtggctgaccccagcaagcagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcacggtgggctgccagcagaatgtggccacgacccagatccacgctgtagggtccttacctgttccctttagggctctgcctggtcacaggttccagagggagcagggccctgctgacatctggatttcagacttccagcctccagggctgtgaggcaataggtttctgttatttcaagcaacccaatttgtggcaatttgttacagtagccctagaacactaatagac

SEQ ID NO: 461566 - DNA, 1141 bp, Homo sapiens
gatccctgatacggcctctaccctggagcctgtcctgacaccttaattgctccttcctcttgaatggtccttgtggaccagcttcttaactggccccttctctccacgctgctgacggcagtgattccaggctcccattgctgcatgtcttaagtccagggcactgagtggatgatgcaggctgtgcacagccgctgcacaccctggtgccacggaacctgcacgaaccccatggagtgtgctcgggtgttccacacaggtggggcaaggctggtgctgtgtggaaagaactgggagaggctagagaacctatatgatgccttgatcagcgtggctgaccccagcaagcagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgactttctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcacggtgggctgccagcagaatgtggccacgacccagatccacgctgtagggtccttacctgttccctttagggctctgcctggtcacaggttccagagggagcagggccctgctgacatctggatttcagacttccagcctccagggctgtgaggcaataggtttctgttatttcaagcaacccaatttgtggcaatttgttacagtagccctagaacactaatagac

SEQ ID NO: 461567 - DNA, 5811 bp, Homo sapiens
gtgtgggtctgcacaccctgggggaggcagagggcctcttggtagacacggtcatctcagacctcggtcagtacctccttccctctgcaggccccctccctctgtccatctgcctcctcccttgggcttgctgcctctacatgccctgatctgaaacctgcctcccctcctcatggagccctccaagatgctcctagccccagctctctggtcccgcagcaacttctggtgccagattctgccttctcagaagtctgggaggcagggccccacctggccatagccttcttggtctgctctaggcactgctagccttgaagcctccagcctgctggatgcctccatccccggctatgctgtggctctcctcattctaggcctcctgctcgtcacattcacccttgtcctggtgagtgtctggctgggcccaggctccttcctgaggggcaggctgagcctttgatgccttgagccttgagccaagctgaggagtgagcaggcccctttacacccctgattcccccacccaagcccagcatctcctcatcctccagctggggctgcagggtttggggccagggggctgggcctgatcccagtgtccccacccttcttgtcaaggtgctaaagtggagggcctcccatggggtgttcagcctgggtgtgtagaagcacacagtgtggtacagaggaccctctccagacaggtgacccctcatgctgctgctccctctgctgaaacccaaactgcaaacctctcctctccctgccttcaccttgccccacggcttccacagacagtgcctcaaccccgaggaatgaatccgaagttccaacaccactgactttcccaggaactcagagccagagagggccaaggaccagctcgaggacacacagccagggcttcttccctccgaaacccccaaggactggacttgcagggctgggacagaggtggggtgggggaaagcaatgccttgtcaacccacgtggggagccccactcccatccccaaggtgcataaagttgaggaacacccctgctcccacgtccatgctcattcagggccctgctccaagtgcttggcactcacaccagcctcctgccctccacagggcaggtgtggggccgccggggcaaggcaagctcccagggcagagactgaggccaccccctgcagccccactgcaggggggaacactgggataggcaagggtcttaacccagaaagccccagcagctcccgggcccatcaggacaccattgaggcttggcggtggtggaacccaggaatggtctttgaacccatgacctggaagggggagccaaggatagtcctggcctgaaggctcccctacctgcaggcagtgggcaagcccagcgaggggaccccaggaacccagaccatgagcttacgtggccaaagacagcagccagcaccaagacatcaaagagggcgggaccaggagagctctggagcccaccccgacacccattggaaacctggaatccgcacctgcaggagatcaggagaggggtttggcctccgatgcacctgcagcaagcagaggagaaggggcagccgcccatcaggccattgcccagattgaagccactgaagctaggtcccaacaggcacctcagcaggtttgggtccaccttcatcatgatcagggagtgggtccctgggatcacaaaggtgaggggcagcttcttgggctccaggtgctccaagctaaaagaatatcagcagaggaacagccctggtgttccagcaggagtgaagatgaaaaagaaaaacactggcagtagccctgagacagccacttttggtggttgccactcacctggggctattcaggacattctgaaggtgctggtgtccaatcttaaccattccaatggggtagcactcccccattggataagtggaagcatttgcttggcttttctcccaaacattcaattccaggcaatcgacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacagggacggagtgtcctgcccagaaggcagcatggtcatttctcgctacttttgtgtatggctgttagaggcagctgctgtgggtgagttggggggcactgtggagagtgagcactggatgcagagctcagaggccaagtgcttgccctgccctttcctggcttcctcgagctgcagagaagcggtcctccagtggcggttacagcagaccataaaggagcaggcactgctgaacgcacacgtgacacaggagcaggacgagaggctccgagagcaggaggagtggagggtgcgggagcaggagagactgtgtgagcaaaatgagaggcttcgggagcagcagaagacgctacgggagcagggtgagaggctgcgaaagcaggagcagaggctatgcaagcaggaggagaggctgcgaaaggaggaggagaggctgcgaaagcaggaaaagaggctgtgggaccaggaggagaggctgtgggaccaggaggagaggctgtgggagaaggaggagaggctacaaaagcaggaggagaggctcatgctctcccagaaccacaagctcgacaagcagctggccgagccacagtgcagcttcgaggatctgaataacgagaacaagagcgcactgcagttggagcagcaagtaaaggagctgcaggagaggctgggcgagaaggagacagtaacctctgccccatccaagaagggctgggaggaaccagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacggaggagcaggcacggctatgtgggcagtggaaggtgcgaaggctgtgccacctgcacctggctcatctggtggccttggcctggaaggagccagaggcagaggccccagccccagggactgggggtgactttgtgtgtggggagagctaccaggccctcaaggaggctatggagaaggtgaagagcggctttatggacctcccgaaggagaaggtgggcaggaaggagcaggtggaaaaactagagcttggattcgtccagctctctggagcgacagacggcatgagagagtacatcactgaatatgagagccagggggcagtgccaaacacgcggcaccaggagaaggaagacatcatcaggctggcccagaaggaggaggagatgaaggtgaagctgctggagctgcaggagctggtgttgccccttgtgggcgaccacgaggggcatggcaaattcctcaccgctgcccagaaccctgccgatgagcccgctccaggggccccagccccccaggaacttggggctgccgatgagcagggtgatttttatgaagtgagcctggacgatagcgaggagcctgcaccgggagcggccggggagggttctccccatgacaaccccactgcacagcagatcgtgcagctgcctcctgtaatgcaggacacccaggagcacccaggcttgcccggcaacccctgtgtgtcattcttttaccaggcagccgagaacagggagataaacatcatcatctaagagctggtcaagaaattaaaaaaaaaaaaaacaaaaagttatggggttcatctcctacacaattcatttactccatttgaatgttagagccactcatgtttatttgtgtttctaatttacagtttaaatttatttgtaaaaagttaagggagagtgggtctttccctgatgttcactctggcatcctttagcatttttgtttttaatttgataattgtagccacgttggtttctctgacataggaatttacttctttcccttgactggaaaacactttaaaaataataaaaaccattattataaaccaatatatgtgagagtacttagttgaaacaaaaaggagttttagtagacagtattatactacacatgaaaatcaaggtgaagtttatgcaacttaaaatgtttacaagctgccgtgcaatctaatgtttgtgaatgtccaagtattatgaggaaaagtgtctatacaattatagagttatatttcctcacagggttctttacaaagagtgaaatatgtttttatacctctcggtttcagttagaggcatattttgtgccatatttatgttaatgtgcctatacatgatgaatgaattatttcagtcatacattgcctaaatcataactttaagatgcttgggaaagaatcaacagctaaaatttcatgaagttctaaagtctgtgttccaaaatacgtcacattattaggatgcagggagagatgcatgtgtgctctctggggtgggcatttctagtgattagaccatctccatttttagcatttggcatcttcattgatacttttatacatacgacattaataggagagcaataataagattttacagatgaaataacagatttgcctgcagtcactgaaagagtgcaaatattgggttattgtgacttcaactgactcttccaaattgtttgaatttatcaatgtattagataaacccagtttcagaatgataaggaaaaactgttagaccaaataatgtggctaattaacagtggtacaatttctagcctgagggtttaaaatggacttaaggtcctgttcttgcctcctattttgtgaacttgccgcttttgcattatttgagttcacttgaaagacagttactttaagtccattttaaaccctcgggctagaaatcatactactgttaattagccaacttacttggtctaacagtttttctttataattctgaaactgggtttacctaatacatttataaattatttcaaaggtatttttatagttcagatcacttcacttttaccctgataaatataaatgactaggaatgaccttcagatagcctttagcacctgtaaccaatctgacaataatgtgttcatcaggtacctatggattaaatcacacactggcatatttaagctgaatgtcagtctggaaaatgaatgtactatattaactgaaataccactctttgtgtaggtattctgtcatatatttaagaaaaattaaatagcatgtaaatcgtatgacaataacctaagtctttcttcaaagtgcatgcgttcctttgcaatacctcattcagccaagtatttgttctcttcctcattcagtataaggcagctttcaatttgcttagaaggcaatattggaaggttagagtttatcagaaacatagaattttaaagtgtgagttcaactgaataaattagaatttctgtagaagtgaagaattaaaatacctatttaaatattgcaatatataataatttttaaagtatttgattaaacctgataggtttttccagaaatgaaaaaaaatcagttctaaaaccaaagctgatatttagaaaatctgaaaatgtaaatcagccctatccataatatagtttctctaaaactttatcttaaagagtcgttttaaaagaatataactatttaaaaatgtaactgctatcttaatgttttgaaataagttaaaacattttaaaatatgaatactgtagtttaaaagaaacc

SEQ ID NO: 461568 - DNA, 5599 bp, Homo sapiens
gtgtgggtctgcacaccctgggggaggcagagggcctcttggtagacacggtcatctcagacctcggtcagtacctccttccctctgcaggccccctccctctgtccatctgcctcctcccttgggcttgctgcctctacatgccctgatctgaaacctgcctcccctcctcatggagccctccaagatgctcctagccccagctctctggtcccgcagcaacttctggtgccagattctgccttctcagaagtctgggaggcagggccccacctggccatagccttcttggtctgctctaggcactgctagccttgaagcctccagcctgctggatgcctccatccccggctatgctgtggctctcctcattctaggcctcctgctcgtcacattcacccttgtcctggtgctaaagtggagggcctcccatggggtgttcagcctgggtgtgtagaagcacacagtgtggtacagaggaccctctccagacaggtgacccctcatgctgctgctccctctgctgaaacccaaactgcaaacctctcctctccctgccttcaccttgccccacggcttccacagacagtgcctcaaccccgaggaatgaatccgaagttccaacaccactgactttcccaggaactcagagccagagagggccaaggaccagctcgaggacacacagccagggcttcttccctccgaaacccccaaggactggacttgcagggctgggacagaggtggggtgggggaaagcaatgccttgtcaacccacgtggggagccccactcccatccccaaggtgcataaagttgaggaacacccctgctcccacgtccatgctcattcagggccctgctccaagtgcttggcactcacaccagcctcctgccctccacagggcaggtgtggggccgccggggcaaggcaagctcccagggcagagactgaggccaccccctgcagccccactgcaggggggaacactgggataggcaagggtcttaacccagaaagccccagcagctcccgggcccatcaggacaccattgaggcttggcggtggtggaacccaggaatggtctttgaacccatgacctggaagggggagccaaggatagtcctggcctgaaggctcccctacctgcaggcagtgggcaagcccagcgaggggaccccaggaacccagaccatgagcttacgtggccaaagacagcagccagcaccaagacatcaaagagggcgggaccaggagagctctggagcccaccccgacacccattggaaacctggaatccgcacctgcaggagatcaggagaggggtttggcctccgatgcacctgcagcaagcagaggagaaggggcagccgcccatcaggccattgcccagattgaagccactgaagctaggtcccaacaggcacctcagcaggtttgggtccaccttcatcatgatcagggagtgggtccctgggatcacaaaggtgaggggcagcttcttgggctccaggtgctccaagctaaaagaatatcagcagaggaacagccctggtgttccagcaggagtgaagatgaaaaagaaaaacactggcagtagccctgagacagccacttttggtggttgccactcacctggggctattcaggacattctgaaggtgctggtgtccaatcttaaccattccaatggggtagcactcccccattggataagtggaagcatttgcttggcttttctcccaaacattcaattccaggcaatcgacatcctcacattggaaaaggcagacttgaagaccaccctttaccatactaaacgtgctgcccgacacttcgaagaagagtccaaggatctggctggccgcctgcaatactccttacagcgtattcaagaattggagcgggctctctctgctgtgtctacacagcagcaggaagaggacagggacggagtgtcctgcccagaaggcagcatggtcatttctcgctacttttgtgtatggctgttagaggcagctgctgtgggtgagttggggggcactgtggagagtgagcactggatgcagagctcagaggccaagtgcttgccctgccctttcctggcttcctcgagctgcagagaagcggtcctccagtggcggttacagcagaccataaaggagcaggcactgctgaacgcacacgtgacacaggagcaggacgagaggctccgagagcaggaggagtggagggtgcgggagcaggagagactgtgtgagcaaaatgagaggcttcgggagcagcagaagacgctacgggagcagggtgagaggctgcgaaagcaggagcagaggctatgcaagcaggaggagaggctgcgaaaggaggaggagaggctgcgaaagcaggaaaagaggctgtgggaccaggaggagaggctgtgggaccaggaggagaggctgtgggagaaggaggagaggctacaaaagcaggaggagaggctcatgctctcccagaaccacaagctcgacaagcagctggccgagccacagtgcagcttcgaggatctgaataacgagaacaagagcgcactgcagttggagcagcaagtaaaggagctgcaggagaggctgggcgagaaggagacagtaacctctgccccatccaagaagggctgggaggaaccagctgccagccaccagaaccaacagctagagacccagctaagcctcgtggctctccctggagaaggagatggaggacaacatctggacagtgaggaggaggaggcgcctcggcccacgccaaacatcccagaggacctggagagccgggaggccacggaggagcaggcacggctatgtgggcagtggaaggtgcgaaggctgtgccacctgcacctggctcatctggtggccttggcctggaaggagccagaggcagaggccccagccccagggactgggggtgactttgtgtgtggggagagctaccaggccctcaaggaggctatggagaaggtgaagagcggctttatggacctcccgaaggagaaggtgggcaggaaggagcaggtggaaaaactagagcttggattcgtccagctctctggagcgacagacggcatgagagagtacatcactgaatatgagagccagggggcagtgccaaacacgcggcaccaggagaaggaagacatcatcaggctggcccagaaggaggaggagatgaaggtgaagctgctggagctgcaggagctggtgttgccccttgtgggcgaccacgaggggcatggcaaattcctcaccgctgcccagaaccctgccgatgagcccgctccaggggccccagccccccaggaacttggggctgccgatgagcagggtgatttttatgaagtgagcctggacgatagcgaggagcctgcaccgggagcggccggggagggttctccccatgacaaccccactgcacagcagatcgtgcagctgcctcctgtaatgcaggacacccaggagcacccaggcttgcccggcaacccctgtgtgtcattcttttaccaggcagccgagaacagggagataaacatcatcatctaagagctggtcaagaaattaaaaaaaaaaaaaacaaaaagttatggggttcatctcctacacaattcatttactccatttgaatgttagagccactcatgtttatttgtgtttctaatttacagtttaaatttatttgtaaaaagttaagggagagtgggtctttccctgatgttcactctggcatcctttagcatttttgtttttaatttgataattgtagccacgttggtttctctgacataggaatttacttctttcccttgactggaaaacactttaaaaataataaaaaccattattataaaccaatatatgtgagagtacttagttgaaacaaaaaggagttttagtagacagtattatactacacatgaaaatcaaggtgaagtttatgcaacttaaaatgtttacaagctgccgtgcaatctaatgtttgtgaatgtccaagtattatgaggaaaagtgtctatacaattatagagttatatttcctcacagggttctttacaaagagtgaaatatgtttttatacctctcggtttcagttagaggcatattttgtgccatatttatgttaatgtgcctatacatgatgaatgaattatttcagtcatacattgcctaaatcataactttaagatgcttgggaaagaatcaacagctaaaatttcatgaagttctaaagtctgtgttccaaaatacgtcacattattaggatgcagggagagatgcatgtgtgctctctggggtgggcatttctagtgattagaccatctccatttttagcatttggcatcttcattgatacttttatacatacgacattaataggagagcaataataagattttacagatgaaataacagatttgcctgcagtcactgaaagagtgcaaatattgggttattgtgacttcaactgactcttccaaattgtttgaatttatcaatgtattagataaacccagtttcagaatgataaggaaaaactgttagaccaaataatgtggctaattaacagtggtacaatttctagcctgagggtttaaaatggacttaaggtcctgttcttgcctcctattttgtgaacttgccgcttttgcattatttgagttcacttgaaagacagttactttaagtccattttaaaccctcgggctagaaatcatactactgttaattagccaacttacttggtctaacagtttttctttataattctgaaactgggtttacctaatacatttataaattatttcaaaggtatttttatagttcagatcacttcacttttaccctgataaatataaatgactaggaatgaccttcagatagcctttagcacctgtaaccaatctgacaataatgtgttcatcaggtacctatggattaaatcacacactggcatatttaagctgaatgtcagtctggaaaatgaatgtactatattaactgaaataccactctttgtgtaggtattctgtcatatatttaagaaaaattaaatagcatgtaaatcgtatgacaataacctaagtctttcttcaaagtgcatgcgttcctttgcaatacctcattcagccaagtatttgttctcttcctcattcagtataaggcagctttcaatttgcttagaaggcaatattggaaggttagagtttatcagaaacatagaattttaaagtgtgagttcaactgaataaattagaatttctgtagaagtgaagaattaaaatacctatttaaatattgcaatatataataatttttaaagtatttgattaaacctgataggtttttccagaaatgaaaaaaaatcagttctaaaaccaaagctgatatttagaaaatctgaaaatgtaaatcagccctatccataatatagtttctctaaaactttatcttaaagagtcgttttaaaagaatataactatttaaaaatgtaactgctatcttaatgttttgaaataagttaaaacattttaaaatatgaatactgtagtttaaaagaaacc

SEQ ID NO: 461569 - DNA, 1118 bp, Homo sapiens
agggaagggtttggtactggaaagatgctacttctccctacgcgaaggcattccataccgaacagcaaaatctcaccaggcattgctcatggaaattgacaaggtggacaggaaatactcaagaacagtcccagggttccctccatgctgcaggatgaccgcaggcaggcaaaggtgcagtgggactccaaaagccagcagtgtgggctggccagaagacagcagcagaagaatcgtcacgcccccttaactaaagcaccgctgggatttccacgggctcttttctccggcttgtcattgtgcacaggtgattttttttaatttaatttttttttttagtattaaatcatttttggaacaataggataaaaaccttgtataacatttgtctactcctaaaagcaatttctagaatgcacagggcaaaggcttggtgttccacttacacaggcaaatgtgtctgttcttgagtctggctgcacaggtgacttgtcttgctcgggctggggtggccgcagaggaggaaccccagctccttttgagctcctttgagcgaaagctgcctgctggtgggtggctggaaggtctggagccatgcctttgtggccaccaaccccctcgagccccaaagagaaaagagaacagaaagagcacacctctgtggcccaggcgccttcccatcagaagcccacaccccaggcgccttccggccgggcgactggcgctgctggcctggacgggccctgggggtgagctccaggcggcgaagtcccccttgcctggggctgaggagctcggaggccgcgcccaggcgcttctgctgcccggggctgcaactagaaacccgctgaggctcgggtgcgtccaaggcgtcggccccgcgcggagaaccgcggcgtccgctgatgtgtaatccacacgcagaagccctgctccaagcagctcctgctccaagcagctcctgcccctgctccggggctttattacagggaggatttcatgtcaaggggcatcttgacttccctgttccagcgcaaaatccttaaaatagatgaagacattgtgaattaattctacgttattccaggacaaaaacccctaagataatcggagcgatt

SEQ ID NO: 461570 - DNA, 2937 bp, Homo sapiens
tgtggtttatcaattgtgataggttacttattcgagcccctgtttacaagagttttaggatgaaacactacccatttaccagtttacagacatttaggtcgtttcgagttatgaataatgctgtgaacattcatgtgcaagtctttatgtggacttttgaggacatccacaggtatcctttgatgtgtagggaccggaatggaaaactaaaagcaggagctaaggttactctcttcatctctgagtaccacagtttcttggaatcttcatcaagcttttccaggtcatactggctgagtgcactgaacccagaatctctaaggtttcagtgcacaggacagcttttatctcaattgcagcttcctcctagtgatggtggcggctcatctggagcagctgctgcggtgaaggccgctgcagtaggagggggtgcacctggggctgtgccctctgtggagcccgtaggggacactggtctttgcagcagaagctgcttgcagtacatctggtccagccagagcctcacatggagccagtgcctgtgctggtgcttggtgctgcccgctccgcagcagcagctggtatgcctggctgtgcgcagtggccggattccacactgacttgctcatgcatcccttgtcactgagtgcttggctcacccttagtagccgtgggatccgggccaataaataaattgactatttatattcattgcctaattttctattgacttgtatatttttcttgtgaaagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcagctcactcaagaacccagcccccatagtgtgaggaggcctaggacagttacagaagccatgtgtaggtgttctggctccagcaaaagtcttatctgacaacatcaactacatgttagtgggtataacctcatcctggagcagggcaccctatcgtcagatggtatcatctttaaggggttgtctcagccatgcctttagaattacctttcattgcttgtcatgctggaagcttctgaatgttgcattttgtgatagaaacagtgggtaccatggtcatgtgctcacatctcctttgcggtaaagaaaaggatcactcattaacatccaccagataacattctccatgaaagcaccaaataaggtttgtcttggtccattttatgctgctataacagaacaccacagactgagaaatttataaggaatagaagtttatttgcctcatgtttctggaggctgggaattccaagatcaaggggctgcatagattgaggtcctttttgctgactcataacgtggaaagagagtgcactgcatagaagaaaggaggccaaactcattcttttatcatgagcctactcctgaaataactcactctcaagataatggcattaatccattcatgaaggcagaatactcatgatgtaatcacctcttaaaaggtcctatttcctaacactgttgcattagggattaagctgtcaacacatgaatattgggggacacattcaaaccatagcaagagttctttgtctttgtgactcggtgtggttcagcaaattgcgattggtctgctatagcggactttcccctcacctcccaaatgtttattatgaaaaatttcattttaaagaaaggtggaaggaattgttgaaagaatatgtcatctagtttctactgttgttaacattgtgtcatatttgccttttcatccatccaaccacccatccatctagctaccttataattactattattacttattattactattatttttaaagacacctctattaaagcaaccatcttattttttgattttatttattttcaaagttagttgcagacattagtatactttactcctagacattttagcgtgaacataattaactggagtataatacttgttttcaatttctttttatttttgaggtaaaatttacatacagtgaaatccaaatcttaagtgtaccactagataaattttgataaatgcattatgcctggtcttcacacacccttttcaatatatagaaaatttccagataatttattttgttgtttttttcacacactaagttctagacttttccaggtccgagggaactattaggggggaaagtacttgttatagtaaaaaagattttaggtgtgtttgtttttaaggtgcagaaacacatcgcagattaaggtctgcatctctgctttttgttattgttccagtttgatctcagtgacattacaagcaagcagaaacactcagacatgaaatggccagtgcctgtgagttaagagcaggatctaggtctatttttttgatatgtatctcaactacctggaatactttatacttttggcactcaataaatatttgttgctgccagacgatctgccacaaaaatttactgggtctattttatggctattgtttgttcaccttgaaaataatcatgggatcatagaagtcaaagtcatggagagcagcacagaggtttctcagctgttgataagttctttacagtaaagcagggttaaatgtagaaggtatgatactgagagcttctcaaagttttcagttctttgtattaaattctttctgtccaaatggctgatatggtttctgcctctttattgaacccagactaatagaattgtcatactaatttgttaattagcaagacaatttagggtcatatcttaactgtacattctgtctagtatttactatttatactgttatccataatacttagtgaataatgatgacatacact

SEQ ID NO: 461571 - DNA, 1528 bp, Homo sapiens
tgtggtttatcaattgtgataggttacttattcgagcccctgtttacaagagttttaggatgaaacactacccatttaccagtttacagacatttaggtcgtttcgagttatgaataatgctgtgaacattcatgtgcaagtctttatgtggacttttgaggacatccacaggtatcctttgatgtgtagggaccggaatggaaaactaaaagcaggagctaaggttactctcttcatctctgagtaccacagtttcttggaatcttcatcaagcttttccaggtcatactggctgagtgcactgaacccagaatctctaaggtttcagtgcacaggacagcttttatctcaattgcagcttcctcctagtgatggtggcggctcatctggagcagctgctgcggtgaaggccgctgcagtaggagggggtgcacctggggctgtgccctctgtggagcccgtaggggacactggtctttgcagcagaagctgcttgcagtacatctggtccagccagagcctcacatggagccagtgcctgtgctggtgcttggtgctgcccgctccgcagcagcagctggtatgcctggctgtgcgcagtggccggattccacactgacttgctcatgcatcccttgtcactgagtgcttggctcacccttagtagccgtgggatccgggccaataaataaattgactatttatattcattgcctaattttctattgacttgtatatttttcttgtgaaagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcagctcactcaagaacccagcccccatagtgtgaggaggcctaggacagttacagaagccatgtgtaggtgttctggctccagcaaaagtcttatctgacaacatcaactacatgttagtggcctttccttgaaattgctggagcttgtgcatcatcaaaataatggcataaaccaaggaagaagaaaacaaaattgaggaaatgggatccaacacaaaagagagacaacaggattaattgagtgttggtgaaaagccacagcctgtaaataatgcagttcgaactgaaatagaccaggaggctcaaggagagacttcttcaagaagataaaattgatagaatgcctaaggagtttgagtgcattgagaatagattcatatcagttctggagaactgggtggatacattaatgttaagtacatagaaaagttaaaaatgaaaaaaattctcaattctagggaaaataatcatagtaaactacatgttttagttaccaatagtgtttacgtagtcaatataaacaatgggcattgatataaataatgtatgttgatctgctataacaaggtaaaatgctattggggaaacaa

SEQ ID NO: 461572 - DNA, 1912 bp, Homo sapiens
tgtggtttatcaattgtgataggttacttattcgagcccctgtttacaagagttttaggatgaaacactacccatttaccagtttacagacatttaggtcgtttcgagttatgaataatgctgtgaacattcatgtgcaagtctttatgtggacttttgaggacatccacaggtatcctttgatgtgtagggaccggaatggaaaactaaaagcaggagctaaggttactctcttcatctctgagtaccacagtttcttggaatcttcatcaagcttttccaggtcatactggctgagtgcactgaacccagaatctctaaggtttcagtgcacaggacagcttttatctcaattgcagcttcctcctagtgatggtggcggctcatctggagcagctgctgcggtgaaggccgctgcagtaggagggggtgcacctggggctgtgccctctgtggagcccgtaggggacactggtctttgcagcagaagctgcttgcagtacatctggtccagccagagcctcacatggagccagtgcctgtgctggtgcttggtgctgcccgctccgcagcagcagctggtatgcctggctgtgcgcagtggccggattccacactgacttgctcatgcatcccttgtcactgagtgcttggctcacccttagtagccgtgggatccgggccaataaataaattgactatttatattcattgcctaattttctattgacttgtatatttttcttgtgaaagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcagctcactcaagaacccagcccccatagtgtgaggaggcctaggacagttacagaagccatgtgtaggtgttctggctccagcaaaagtcttatctgacaacatcaactacatgttagtggggtttgtcttggtccattttatgctgctataacagaacaccacagactgagaaatttataaggaatagaagtttatttgcctcatgtttctggaggctgggaattccaagatcaaggggctgcatagattgaggtcctttttgctgactcataacgtggaaagagagtgcactgcatagaagaaaggaggccaaactcattcttttatcatgagcctactcctgaaataactcactctcaagataatggcattaatccattcatgaaggcagaatactcatgatgtaatcacctcttaaaagtttgatctcagtgacattacaagcaagcagaaacactcagacatgaaatggccagtgcctgtgagttaagagcaggatctaggtctatttttttgatatgtatctcaactacctggaatactttatacttttggcactcaataaatatttgttgctgccagacgatctgccacaaaaatttactgggtctattttatggctattgtttgttcaccttgaaaataatcatgggatcatagaagtcaaagtcatggagagcagcacagaggtttctcagctgttgataagttctttacagtaaagcagggttaaatgtagaaggtatgatactgagagcttctcaaagttttcagttctttgtattaaattctttctgtccaaatggctgatatggtttctgcctctttattgaacccagactaatagaattgtcatactaatttgttaattagcaagacaatttagggtcatatcttaactgtacattctgtctagtatttactatttatactgttatccataatacttagtgaataatgatgacatacact

SEQ ID NO: 461573 - DNA, 1464 bp, Homo sapiens
tgtggtttatcaattgtgataggttacttattcgagcccctgtttacaagagttttaggatgaaacactacccatttaccagtttacagacatttaggtcgtttcgagttatgaataatgctgtgaacattcatgtgcaagtctttatgtggacttttgaggacatccacaggtatcctttgatgtgtagggaccggaatggaaaactaaaagcaggagctaaggttactctcttcatctctgagtaccacagtttcttggaatcttcatcaagcttttccaggtcatactggctgagtgcactgaacccagaatctctaaggtttcagtgcacaggacagcttttatctcaattgcagcttcctcctagtgatggtggcggctcatctggagcagctgctgcggtgaaggccgctgcagtaggagggggtgcacctggggctgtgccctctgtggagcccgtaggggacactggtctttgcagcagaagctgcttgcagtacatctggtccagccagagcctcacatggagccagtgcctgtgctggtgcttggtgctgcccgctccgcagcagcagctggtatgcctggctgtgcgcagtggccggattccacactgacttgctcatgcatcccttgtcactgagtgcttggctcacccttagtagccgtgggatccgggccaataaataaattgactatttatattcattgcctaattttctattgacttgtatatttttcttgtgaaagaactagatagagatagtggttgtaccatattgtgaatgactaattgtaaatgtcactttattgttcactttaaatgattacttttacattgtgtaaatttcaactcaattttaaaaatttaaaaatggaacaagggagaggatttagaaggttctaaatgctaaaagaagttaatgatagaattcagctcactcaagaacccagcccccatagtgtgaggaggcctaggacagttacagaagccatgtgtaggtgttctggctccagcaaaagtcttatctgacaacatcaactacatgttagtgggtataacctcatcctggagcagggcaccctatcgtcagatggtatcatctttaaggggttgtctcagccatgcctttagaattacctttcattgcttgtcatgctggaagcttctgaatgttgcattttgtgatagaaacagtgggtaccatggtcatgtgctcacatctcctttgcggtaaagaaaaggatcactcattaacatccaccagataacattctccatgaaagcaccaaataaactaaccagaattggctacagtttcttcaagaaaataccccaatggaagaaaaaaaggtggagggagaaactgaatgaagaaaggatgatttgaaattaccagaaagtggaacgtggaaaaaacagagtaaaactagtttgagaataaaatcttaggttgtaaa

SEQ ID NO: 461574 - DNA, 2143 bp, Homo sapiens
gatcatcagggcagatttcctccttgctgttttcatgatggaatctacgggtgttggagaagacccctcctgaaatcctccagaagagctttttgagggagcttgtggctcctgttcacccagccccgggtaagaaaagggtcgcgaacctgcattgcgaggtggtctctccctcacaccacctctgatgtcccaaaagacggggagaaagttgcccgccccgggctgcggcggggcctgctgctccgccccggcgctggcgggcgcgctctacactggccgccgaggggcgagcgcgggacccggaggcgggcggcgggcggggaaggcgcggggcgtggtttgccgctttccgagcgccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacggtgggtgagcgcggccgcggggccccagcaccccggtgcgccccggagagagtgggagggaggggaaggggcgggggcgagagagggaaaggtctctgagccgggggcgggggcggcgggagacgggaaccgacccgatgccggggtccgagccgggccacaggaaactttgctcgggtggggagagcggggtgcgcggagggcgccgtaaacttgtcagcgggcggggcgctccggggattggagcgagcgccagcgggtggcgtttgtctctctgggttctttgtgtcacctccgggccccagcccgccggtccgcccggctcgggcaggcgctgcgcgggaggctgtgcccgggtgccccggccgccccctcccgggcccaggccccggccctcgggggccgctgattgttttcattcctcgcgtcacgcctgggcgggaaagattttgaacgccgcgtgagctggaaggcggacagccgcggcgcagagattgcaggatcgtgagcggtgcggtgctcgccccggggacccgggaacccgcgggtcggggcgcaccggggctggagagggcgcggggacgggcggcccgggcactggaggggcggcggcggtatcgagggtaagtaaaatggagaaagcaggccctgtggtagaccacagtggagaaggtggaatttctagacttagcaggccagcgctgctacagaagccttccgggggcacttggagcaagcttaatgtggtggatgctgtgtttactgtcaagattcgcttcaaagaaagactcggtgcccagcctcttgggagtgaccgctttagccattgcctcagctgcagtgaaccaccttactcaaaggatggagatggagggtcccacatccagggactaatgaggaggatccagagaggcaaccctcaccctggccttactgacattgccagccagactgaagatttagcacaacccagaagagcttatcaaagaatggcatctagtcctgagcttcccaccgaagatgaacagggttcctggggcatcgacgatctccatatttcattgcaagggaaagagaatagagcaggacaagagggatcgggagttgggggtgttacaattttagatcggacagtcagggtagacctcttagatgaggtgttgtctgagccaggatttgaaggaggaatctgtcgcagtaacccaggtggaggtgatggtgacttgggccagggtggtggtgatggaggtggtgagaagtggtcatatcctgaatatattgtgagggtggacctaacaggatatctggaggcattagatatgaaacgtgagagaaagggaggaggcaaccttgatgaaggaggaaaatcaggagtctggttcctggaagcaggagaggagaatgatcatctatatcagatgctgctgatgggtccagcaggatgaaggttgagaatagaccattggttttcatgagagtgtgtcatcgaggaccttgattcaagtgaccatgatgagaagctgtttcagtcgaatggcagggacctaatcggtatgggttcagttaagagtgagggaggagaagaccttgagacagtaaacacaaactatttgagggcatttgc

SEQ ID NO: 461575 - DNA, 1042 bp, Homo sapiens
cttctgcgtacaggcacagtatccgacaactgggattgccactctcacacatggacaaagcccacagggatgaggcctcattatgttgcttaggctggagtgcagtagctagtcacaaacacaatcatggtgcattacagcctgggctcaaagggtcctcctgacttagcctcccgagccgttgggactaaagggacatgtcaccacacccggctatgtttttaaaaaccacttttacactattgcacatttttggacactgggaacaaacagattttgactctcaagaaaaaagtacttcatggcacattaaacaatgagtgaatgagtttacaaaacacaagaggcagggtagttattccaaaatgacaagaaacaacattgtgcctttgcttttgtttgaagagaaataaactgtttccactcaagttttaaatgccaaaatagctaattactgttaaaatgtcaccaaaattaaaaactatcatggcagcgcatttgttccggagcacttcatcaccccaatacagctactggggaaccggagcaactctgcactgcgctgcgggtcagctcccggcagggcgggcacggacggctctgaggaggcgcccgttggcggagggggagcttcgcgaaccggcgctgccgctaggctcatggttctgtcctgagagaaggaagaggcatctccagttccaacctgtggcagcaggaacagcaaccacggcgaccgcaaaacctgaactccttattggaaggcggagatatgttctgcagttacattgccttcacaggcaatgtgaggaggggctgcgctggggccttacagacacctgcggagccagaggccaccagactgcaggcagccaaaggcagcctcctccctgctggctgctgtggctcccacctggatgccctgatatgcattgcctggagccaaacgggaccagttgactgcatatgggtgaatttatttctaggtcctctattctgtttcagtggttcctattatttgcctatttggggtctttcatggctc

SEQ ID NO: 461576 - DNA, 406 bp, Homo sapiens
cttctgcgtacaggcacagtatccgacaactgggattgccactctcacacatggacaaagcccacaggttgttttttgtttcagagaagctgaacgtcttcaattgaggatggattgcctgtccccaagcctccatatgttcactgaagctgaagctaaatcggagatttcattacccaccatccttccccaggccgtctccttttttccaacccatcttctccaacatcttctgacatttgttactgtcagtaatttcagaatgaacagatgcaggagcaacatctctctagaatgttccttcacttccaatctgctcactatgatttccagctctatctttatattttagattattcagtgtctattcatgttcataatctatattctgtaaaccccaaaaaaa

SEQ ID NO: 461577 - DNA, 908 bp, Homo sapiens
ggcctgagctgggcagggggcggaggcgggggctcggctgtctccggggctgccacgcagagcgggcttcgtggcgtggatgaagaaactgaggcacagagggattaagtagcctgctcaagatcacacagctagtaaggaaccaagattcaaacttgggcagtgtgattcagagactttaaattcaacgctggtgcctcactgcctcacactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcagcaagggaacaaaactggatggagaatgagtttgacaaatcgacagaattaggcttcagaaggtgggtaataacaaactcctccaagctaaaggaggatattctaactcaatgcaaggaagctaagaaccatgaaaaaaggttagaggaattactaactggaataagcagtttagagaagaacataagtgacctgattgagctgaaaaacatagcacgagaacttcaacaagcatacacaagtatcaatagccaaatcgatcaagtggaagaaaggatatcagagattgaagatcaacttaatgaaataaaaaccaatgacaaaaaccacgtgagtatctcaatagatgcagaaaaggcctttgataaaagtcaatacccctttatgctaaaaactaaaaacaataaactaggtatcgatggaatgcatgtcaaaaatcataagagctatttatgacaaacccacagccaatatcatactgaatgggcaaaagctggaagcattccctttgaaaaccagcacaacacaaggatgccctctct

SEQ ID NO: 461578 - DNA, 1030 bp, Homo sapiens
tcagatcggcctaacggctcagatcagccttgcgggttgctgggactacaggttttggcagttatgaatagacgtgctttggttgtgtgaacataaatatttcactcctttgggtgaataccaaggagcaccgttgctagactacatgcaagaagatgagaaagctgtgaggacactcagtcttccacggggtggatactaaccaaaatcacaagcagcttgagctggaaggacctgggagccgggagagatgccggaggagtcccgcgcgctgcctgtcacagctgtgtgacttcgagacagggctctggccccctgggcctcagtgtcctcccctggaaaatggctcattcatttctcagaacatctcgccgggtgaagtggctcacggttgtaatcccatcactttgggaagctgagggaggtgaatcacgaggtcaagagatcgagaccatcctggccaacatggtgaaaccctgtctctacaaaaaattagctgggcatggtggtgcgcacctgtattcccagctacttgagagactgaggcaggaggatcgcttgaacccaggaagtggaggttgcagtgagtcgagattgcaccctgagatcgcgccactataccccagcctggcgacagggactccgtctcatacaaacaaaaaaacaaaaaacaacaacaaaaagaacatctcattacctcagaaagaaaccctgtacccatttgcagtcactccacattcctctctccctcagcaaccaataatctgctttctgcctgttgtggacatttcatagaaatggaatcatacactatgtggtcttttgtgactagcttcttcatttaacctgttcaggattcatccatgttgtagcatcctttttatggctgacccatattccagtgtggatagaccacactttgtttaaacattcatcagatgagggacattaagtatgaataatactgctatgaacatttgcccacaagtttttgtgtggacatatgttttcagttgttttgggtatatat

SEQ ID NO: 461579 - DNA, 820 bp, Homo sapiens
cacagacttagcccatttcaactagcacagaaggacccagaatgccaggtggaagacgctgccatgtgcaacaaaaagagaaagggcccaggctgcatgcacaactaacgaggctgttccctgaggaaagggcatttgctgatttagactcatttcctcaaggtcctcaagcaagcccaagagtacataggccagtcgctgagacactgaaagttgagatgtggaagaaagggccaacagactgtcccagaagcagaatgcttcagtcctccagggaagctttgggggagatctgccctcacggcttcctgattttcgtacatcaacaaggagacgtctatgaccctggtctccagcacacctttcttggtagagttgagaattcaaccagccagttcttcctggagattctcagagccacattgagagagcagaggacttacaagtgctgccctatccatggtgactccccttggcctctaggcttgtctgagcagaggtagagtgaccctgccgcctgttcctcaacagtctgtgcaaattcaaagaaatagagtgtgaattcaaggaactcatttgaagaacaggaaaagcaactctctccttgaggttatcggggaaatgaaggttgaaacatggatcagaagacttgctgaggtcccttccaccctcagctcttccattctgttcccaaatgaggcccaaaacacagctttctccatcactctttaatctgttggttgatttgtctggtgcacccaaccagcactgtggccctgaaaataaaatgttaattacatcaatcttacagccatccatc

SEQ ID NO: 461580 - DNA, 674 bp, Homo sapiens
acccatggacacatgtggcatgggctcctttgggtgccggtggatcccttcatacggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtggtgtgggcatggaaggaaggccagtggagacaatggatgatcttgttcttagcagatcactggatgtggcagggagtcctaggacatgtgtggtgtgggcttcttcaggtgctgagaagcccagagagggtatccacgttgaattgtatgtccataggagggggaaacccaagtcccgtggcccctgaagcatcctggcagtggaaggggagagggccgtgcatgcgtgtaccacacagccttctgtctgggtcacagagcgacgacttcatagtgccttggaagccctgtaggattcagcatgtcttgtgctcttctgggtccccgagctgtacctttgaggaaaacccagaggtggaggttgatttgtgattgagcatgtttctcagtgggaagagtgtcaaaggagcctggggtgaaagtacttcaggaccaaaggaaaattgcccttcactcaagaagaggctttccttgaacctgt

SEQ ID NO: 461581 - DNA, 709 bp, Homo sapiens
gagcccaccctaaaaagaataatgttcctgtctctggagatcacgcaatccatccccaccaccaagcaagggtctgcttttctactctttatcatcacgcactttgtcttagttccagctgctgtaatagaatactatgcactgggcagcttcaacaacaaacatttattactcacagttctggaacctgagaaaattaaggtgctagcagttccagtttctggtgggaacactcttcctggtttatggatagtgatcttccctactaatattagagttattgaagtcttggttacaacacagaggacctggacagggcaatgccacgctcagatgaaggaatactctacagcagctaaaaggaatggatttgacctacatgaggaagaggaagagagatttgagtcaggccactcagctctctcaccatgcgattgccctgcaacaccttggaactctgcagagagtccccagcaggaaggtctcacctgaggtgaaccttcgaccttggacttctcagcctccagaatgaagaatggcaaccatcaaatcaagaaattggcccaaagccctacagtctgcaaacatcataacaattcatcctgaagtttctccatgaattgtgatgctttgctacatcattctgcaatcccagaagattttttgcatatttttttgctattacagaaaaatctcagtctccctccct

SEQ ID NO: 461582 - DNA, 3764 bp, Homo sapiens
ctcccttcaaacaggatcccagagatgtggggagaaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattgcacgccaattatccacacctcagagtcagaaacagactttgcagaatgaatattccagtacagatacaccgtatcccagtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagtttctcctatggagcatgaactttccatcagtgagcagcagcagccagttcagccttctgagtcttctagggaggtcgaatcttctctgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccaccaggaggctacagctcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacagccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacagaggagacctcaactcagcctccagacctgggacttgccatcattccagaacccactacagagactggacattctacagccctggagaagactacagctcctcatccagaccgggttcagagtctgcatcgaagcctgactgaagtcacaggtccacctactgaactagaacctgctcaggattcactggtgcagtctgaaagttacacccaaaataaggctttaactgcaccagaggaacagaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatctttctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcgtgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactt

SEQ ID NO: 461583 - DNA, 2998 bp, Homo sapiens
ctcccttcaaacaggatcccagagatgtggggagaaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattgcacgccaattatccacacctcagagtcagaaacagactttgcagaatgaatattccagtacagatacaccgtatcccagtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagtttctcctatggagcatgaactttccatcagtgagcagcagcagccagttcagccttctgagtcttctagggaggtcgaatcttctctgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccaccaggaggctacagctcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacagccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacagaggagacctcaactcagcctccagacctgggacttgccatcattccagaacccactacagagactggacattctacagccctggagaagactacagctcctcatccagaccgggttcagagtctgcatcgaagcctgactgaagtcacaggtccacctactgaactagaacctgctcaggattcactggtgcagtctgaaagttacacccaaaataaggctttaactgcaccagaggaacagaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttgatcttacctagccatatggcctgctgtctctgccaacttaaaaacagcattgaggctgtctgcagacagtccagctgcattgcacagtgctgtctgtcaacacctacattgtcgttagatgggggggtgtgctccc

SEQ ID NO: 461584 - DNA, 3305 bp, Homo sapiens
ctcccttcaaacaggatcccagagatgtggggagaaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattgcacgccaattatccacacctcagagtcagaaacagactttgcagaatgaatattccagtacagatacaccgtatcccagtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagtttctcctatggagcatgaactttccatcagtgagcagcagcagccagttcagccttctgagtcttctagggaggtcgaatcttctctgacccagcaggagaccccaggtcagcctccagaacatcatgaagtcacagtttcacctccaggtcaccatcaaactcatcatttagattcacccagtgtctctgtgaagcctccagacgtgcagctcaccatagcagcagagcctagtgcagaggtgggaacttctctagtccaccaggaggctacagctcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacagccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacagaggagacctcaactcagcctccagacctgggacttgccatcattccagaacccactacagagactggacattctacagccctggagaagactacagctcctcatccagaccgggttcagagtctgcatcgaagcctgactgaagtcacaggtccacctactgaactagaacctgctcaggattcactggtgcagtctgaaagttacacccaaaataaggctttaactgcaccagaggaacagaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcgtgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactt

SEQ ID NO: 461585 - DNA, 2156 bp, Homo sapiens
ccgtggccaggggcccagagctcatcaaaacctgctcagtccaaggccttaggctgagcctgacatcctgccgtggccctggagagttcccagagtatttcctgacgaaatgaacagaagaccacagccttctgcagcggaggagaagcatgcggagcatccacatctacaaaggccccaaagtggaaaaacctgttgtttttcctgagcagcccggctggaaacaatggcggttttgtttcgcagactccgcagaatctggcgggcagggggatgggggcgccggatgctgcagggaggcggctgagggaaggagggggcgtcgacccttcctgacccacggaggacacctctctggcccgcttcgggggggtggggggtgggtcggtttgcccgggaggaaatcccactgcttcccactcacaagccggtgggtggccgcgaggcctggccgcacagcctcattcctgcgactttcttctgccttgtggcatggctttttcttttcccctaaggaaagtttgcttaaagagaaagagacacacataccattctctggtcctttgaagggttgagctaagctgggtcaagaggaaatggcttgctcagtcacccctgagaacaaaatactcccacgagttttggtgaggcacttgtgtcttctcagctcaaatctctaccaccccacggacaaggcagttcaaatccaggctcaccaccacctgctgtgtgggttgggcaagctgtggacatctctgagcttcggttccttgagtgtagaataagcataacatctgtgtagaaggattactgtgagggatgctgtttgtacacctcccactgccagaacgcaagttccatgaggctggggctgcgttttctgcattgctgcaaaccctctaaaatgtcatccgagttcatcagaaccacaaggaccaccaccaccatcatcgtcaccctcacccaaacgctcaaatctccaagtgtctaaactcatgggtctgtgccaaatgctaccatgcttagcgtccccaaagctagagtcaccacgaagaaggttctctccagtattactgccttaaacttctagcccagaaccctcaataaacttgggcaccttttgtgctgggcctcctttagccgatggctccagggcccctatccctggcacagaaggccatcggcaatgtagggggtaagctggggggggggtggggggtgagccgttcagctctgctgagctgtgctgtctcatgggagtggccccacccttccaggaaccttccttgagcaaaatcgtcaaatgtcagcaggtggtcttgaaatcccttcctctgtgacccagtaattcagagatcttaatgatgtttccccaaagttagaacatagtggctgttccctaacacacacacacacacacaccctttctctgttatgtgtctcccataatttttctgtttctcaattatgtttctttctctgttatgtttgtctattatttcttctttgaattgtcaatgcctgcttctactggtctgtaccaggttctattgcaatcacctctggttggggcaaaactgcacatttagctattttatgagtgtttccttgtacttcatagagggcaccagagcccttgcagcatgtgggcacacgggtcagaggatgcagactgaaaggagcttctggacgtgcattctattctcattctggagccaaggaagtgagaggggaaaagggaagtgattctaagccttttgtggggtctcatacataactcagtttccacaaagctgtgccccagctcagccctatggatagaagcatggtctggggttcctttgctgaccagggtgtgtactttgtccaagttattgaccttcccaaacctcatcaatgcacttaaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcagggtccaggaaagaaataattgataagctagacttcattaaaatgaaaacttctgctctgtgaaagatgctgcc

SEQ ID NO: 461586 - DNA, 3967 bp, Homo sapiens
cactctgctccctgctccactgctttttggctccctgccatgtctcccccactgaacagcttaaagatctggcttgagtttggacactactttgccctggtttttccctctgcaccctacctctcacatccacttcaggtatccactttctgctgctccaagtgccaggctcacagcacccatatccggcaggcctgcctgtcctctcacgcactgacttgcccagctgccccttccctccattctcacacaggagctcagaaccccatttcgtgggaggtgcagcgatttgatgggtggtacaacaacctcatggagcacagatggggcagcaaaggctcccggctgcagcgcctggtcccagccagctatgcagatggcgtgtaccagcccttgggagaaccccacctgcccaacccccgagaccttagcaacaccatctcaaggggccctgcagggctggcctccctgagaaaccgcacagtgttgggggtcttctttgcaccccctcctgcactgcccgcaggctatcacgtgctttcagacctggtgagcgtggaaactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccgccgcggacacccgccgggccccggccttccctagctcgccgccgcccatcgacccgggctcacccgccgcgtgccccgcaggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggccccgggggctgtacggtgaggccacaggggcgggacggggccggctgggggtctgcgagtgtgggctcccccgatcacgctaccgctcgtctcctcccctgcgcccccacgcgctgggcctgctctggttccgctaccacaacctgtgggcgcagaggctggcccgccagcacccagactgggaggacgaggagctgttccagcacgcacgcaaagggtcatcgccacctaccaggtcagccgtccgcgccccgcgacgtcctcccttccgcaacatcgctgtgtatgagtggctgcccagcttcctgcagaaaacactcccggagtatacaggataccgtcctttcctagaccccagcatctccccggaatttgtggtggcctctgagcagttcttctctaccatggtgccccctggtgtctacatgagaaatgccagctgtcatttccggaaggtcctgaacaagggttttcaaagctcccaagctctcagggtctgcaacaactactggattcgggagaaccccaatctgaacagtacccaggaggtgaatgagctgctgctgggaatggcctcccagatttcggagttggaggacaacatagtggttgaagatctgagggattactggcctggccctggcaaattctcccgtacagactatgtggccagcagcatccaacgtggccgagatatggggctgcccagctatagccaggccctgctggcctttgggctggacatcccaaggaactggagtgatctcaaccctaatgtggacccccaggtgctggaggccacagctgccctgtacaaccaggacctatcccagctagagctgctccttggcgggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcggtgagcaggaatggggctctggcaggttggcctggctgagccccctgcagagaaatgaagggagtaggactggctgatcagcccctggtaaaatcaggcatttgccctttgaaagtagctcatggtagcacaaacattccagctgcctctctcaccctatgctgctcggatgcttggctctctccctgctgctccaggccagaatcattctacaaaacaaatcatgagatcctattaattcattttgtgccttgccccctgcctggtaccaggagccactccctacctctaccccatgctctgcccagggagttgttctcctggctgcaaagacaaggggagaacagccccatttctttttctcagctcccacccccagggactggggccccctgccccagaagccccagagctgggaggccctggactgaagaagaggtttggcaaaaagatcggaggtagagtctgtcctggttggcatctctaacagggtctgtctcttccagttttgcacagtgctggccacgcagtcaatgtctacatcttctcagtcagcccactcagcctgctggcctgcatattccccaacgtctttgtgaatgatgggtcagttctggggaaggtttctcctgggactcatagggtgggcccaagggtataatagaaaaagaaat

SEQ ID NO: 461587 - DNA, 1675 bp, Homo sapiens
cactcacctttatgccagacaaagacattgggctgcagggcactggggtcaatgttgataacagcgaccagcacgtcccgcagggtggtatttcggatgtcttcaatgtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgccttgccaccctcggacattgcacagaccaccctcgtgggcatcatcctgtcacgaggcacggcg

SEQ ID NO: 461588 - DNA, 1873 bp, Homo sapiens
aacctcatctgtccaacaaccggacgatgccgcaccctgctgctcactatcccagctagagctgctccttggcgggctcctggagagccatggggaccctggacccctgttcagtgccattgtcctcgaccagtttgtacggctgcgggatggtgaccgctactggtttgagaacaccaggaatgggctgttctccaagaaggagattgaagacatccgaaataccaccctgcgggacgtgctggtcgctgttatcaacattgaccccagtgccctgcagcccaatgtctttgtctggcataaaggtgcaccctgccctcaacctaagcagctcacaactgacggcctgccccagtgtgcacccctgactgtgcttgacttctttgaaggcagcagccctggttttgccatcaccatcattgctctctgctgccttcccttagtgagtctgcttctctctggagtggtggcctatttccggggccgagaacacaagaagctacaaaagaaactcaaagagagcgtgaagaaggaagcagccaaagatggagtgccagcgatggagtggccaggccccaaggagaggagcagtcccatcatcatccagctgctgtcagacaggtgtctgcaggtcctgaacaggcatctcactgtgctccgtgtggtccagctgcagcctctgcagcaggtcaacctcatcctgtccaacaaccgaggatgccgcaccctgctgctcaagatccctaaggagtatgacctggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgctggacatcaaccaggccgacgcagggaccctgcccctggactcctcccagaaggtgcgggaggccctgacctgcgagctgagcagggccgagtttgccgagtccctgggcctcaagccccaggacatgtttgtggagtccatgttctctctggctgacaaggatggcaatggctacctgtccttccgagagttcctggacatcctggtggtcttcatgaaaggctccccagaggataagtcccgtctaatgtttaccatgtatgacctggatgagaatggcttcctctccaaggacgaattcttcaccatgatgcgatccttcatcgagatctccaacaactgcctgtccaaggcccagctggccgaggtggtggagtctatgttccgggagtcgggattccaggacaaggaggagctgacatgggaggattttcacttcatgctgcgggaccatgacagcgagctccgcttcacgcagctctgtgtcaaaggtggaggtggaggtggaaatggtattagagatatctttaaacaaaacatcagctgtcgagtctcgttcatcactcggacacctggggagcgctcccacccccagggactggggccccctgccccagaagccccagagctgggaggccctggactgaagaagaggtttggcaaaaaggcagcagtgcccactccccggctgtacacagaggcgctgcaagagaagatgcagcgaggcttcctagcccaaaagctgcagcagtacaagcgcttcgtggagaactaccggaggcacatcgtgtgtgtggcaatcttctcggccatctgtgttggcgtgtttgcagatcgtgcttactactatggctttgccttgccaccctcggacattgcacagaccaccctcgtgggcatcatcctgtcacgaggcacggcg

SEQ ID NO: 461589 - DNA, 759 bp, Homo sapiens
ccggcgcttcttctaccgggctatctccccgcgccgaggcgataagggcggcgctccaggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 461590 - DNA, 1562 bp, Homo sapiens
ctcgggagggagcaggtccttcttccagaccactttaggggaaatgattgaagtcccacctcctggccagggccggggggttcagcctggaatttcccccttttgggagggccaggcgggcggataccctgagggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggattccctcttggggtcgctgctcttcctcagggatgtttctgccaaagcattcacttcctaaaatatttctcggtccacaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 461591 - DNA, 107 bp, Homo sapiens
cttcacatcctacaagtccctcacacacttgctggtcacagcccctgtgcccatggcctcctcccctaccccgttttctgaccggcttgtgtgattactttctctag

SEQ ID NO: 461592 - DNA, 1732 bp, Homo sapiens
ctcgggagggagcaggtccttcttccagaccactttaggggaaatgattgaagtcccacctcctggccagggccggggggttcagcctggaatttcccccttttgggagggccaggcgggcggataccctgagggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggattccctcttggggtcgctgctcttcctcagggatgtttctgccaaagcattcacttcctaaaatatttctcggtccacaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccagactcccaagttgctgtggtatataactcatcgttcccacgcagtccagaccccagcagggcccagatgatggtttcaaccagagtcctcggcctgcgtgtgaggggagagcgggtggggagaggggatctgaggcattcacaaggcgtcttatgtgccaggtcccaccagc

SEQ ID NO: 461593 - DNA, 824 bp, Homo sapiens
  misc_feature (760)..(760): n is a, c, g, or t
  misc_feature (775)..(776): n is a, c, g, or t
  misc_feature (785)..(785): n is a, c, g, or t
  misc_feature (790)..(790): n is a, c, g, or t
  misc_feature (792)..(792): n is a, c, g, or t
  misc_feature (794)..(794): n is a, c, g, or t
  misc_feature (796)..(796): n is a, c, g, or t
  misc_feature (803)..(804): n is a, c, g, or t
  misc_feature (809)..(809): n is a, c, g, or t
ccggcgcttcttctaccgggctatctccccgcgccgaggcgataagggcggcgctccaggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaganaaaaaaaaaacggcnngttggcctnagggngnantntgcggcnnttccnttagtgaggttaatt

SEQ ID NO: 461594 - DNA, 1440 bp, Homo sapiens
cctgttctctccccagtgagaaagcgtgctcccattttcactcctggatgttcagcacctcagcctgcacctgcacagctctaacaatacgcaagcccaaagagggctgtgcacattatggcctttgttttccagattcgaatgtgccccccagatctccacgccgtgcaatttctcggacaaaccaactcacgtcttcttattggaaatgaacaagagtttctgcagctgctgatgctgccaccatcccgcaacaacgagggaaagagcatgagaacgaagcccaggcacagaagaaaggcagccataaaagtgtcagaaaaacggagccggagcctgattatcctcctcatcttggtacacactcacactcacacactccctatggtgtctgcatcggacaacactcaactcgggattggcacccagccagtgccctacactatacaagatgccactgtagggacagggatgacctctagcaaggtgaccctcagtgggccagagggggcttctgaagagaatttctctagcttcttggtgtttcctgcctgctactttcaaacaagggtcccatttttaatgttttcccagtaataccttatgaatgttattgcaaagcagcgggctaaatcaacaccacaggccccgtgatcaatatatgtgatgaggacattacatcctggtgttgttgccccaagtcttgacgtgaatctgaccacaaggacaattcggacaacctgaaatggtgacgcattctacaaaataaacatcaatgtcatgaaagacaaagactcaagattttctgcttaatggagactaaagagatgcgacaacagaatgccaggcatgatcttggatattcttttggctcaaacagtcttaggacaattgaaaaaacgtgaatgaggtctgtagctaatagaattgtgtcaatgccacatccttggttttgttaattgcattgtggttacagaagagaatccctttgttttcaggaaatgcacacagcagtatttaatagtaaaggcacatcttgtctgcaacttcctctgtgtgtgtgtgtgtgtgtgtgtgtgtgtgtgtgtgtgtgtgtgagagagagagagagagagagagagagagatgcaacaaatatggtaaatattaattttggggactctgggtgaagggtatcttgagatttttgtgctcctcttctgcacatctgaaatcatgtcaaaaaataaaaaaggtgtgcactctgcaagggatacccagatacccatgcagaagagagaactgattcaagagatgaacccaggtgggagccacgatgatgcccactggggaatgagcctgtaaatccaggagaggctgcacctgcagcccattcctccagggtggttctcctagacctgcttcaagtgtcatggtttaaattctcaggcaccccttggg

SEQ ID NO: 461595 - DNA, 238 bp, Homo sapiens
atactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggtatgaccttttgactttcctatgctcaggggtatttcttttcttcctttcctttcttttcttttc

SEQ ID NO: 461596 - DNA, 1558 bp, Homo sapiens
tcgtcgccttcgccccgggctggcggttctcaaagacacctggccatatttgcctagaaaaaaaaaaaactctggtgtatttgacagatggtcagaattgaattctggctccctgcgcagcagttgggattacgattagggatgtggtactggaaagatgaaaccagaactcttgaattcagaagatgaagaaacaaggctcagggagattaagcaactgaaccaaagtcatacagccagtttgccgcagaagattctgtccagtggctcctgaaacatcaccctcattttacacctgcagcagaagtcaaggaaaaaggaaagaaaggcaaagcagttcactttgcagaaactgatggtccagcttcagacaggttgacagataaaagacttgctgcaaaagatgataagtcagctaaagctgtagagaaacgaggtcaacagggcaccattacactggatgatgttaaatttgttactttgcttttgctacaagatactgagatgcagcggatctgttcttttacaacatttatgaggaataagaatcttgataatttcctcatggcattattgtactacttatcccattacttggaaaaaaactcactggaaaagaaacccaaaagctatatggtaggccttgtagagaaaaaagaaatggaattggttttaagtgaattagaagcagcacagaggtacttggcgcagaagtactgtatccttgtgctgggcttggccgtgccggataagcatcacatgtgctgtggaaaggagaaaatatcagatacacagaaagactggaagttctttgagtccttttatactttctgtacatatgtggcttggattgtcttccgacgtcaacacttgacagagattgaagaagaagtagggagactctttcgtaccaatatgttcaacattcctcgcaggaggcgtgaagatgaggaatcaggaggggaaaagaaacgcatgacttttgttcagttcaggagaatgatggcaaaacgcccagcaattaaaaaagctatcaacatgcgttctccagtcatgtctactctgctgccatctctcagagaaaaagctcaaaacgtctttgagaaaaagtatcatcaagtagacgtcagattcccagccgagatgcaaaagcatgtgggaactctggactctgtgcccatgccggtagttggcatcttgggggagcctcgatgtctattcaacccacatacgcttcacccccttgatccagaagaaaacacaaaatcatttgggagatatccttccttgatggaaaacaataacatgaggattcaggatacactggacttggtcatgaaaacactgtcctctcatacatcatgccctaagtaacctggtacattccatatctcaagtaaactactttgactttatagaagatggatttggagaggtgggaagttaggaggggaatattcctggttgtcttcattatctactgctgtataacattacctcaaaacatggtagcttaaaacagcaacatttattgtctcatagttttggtaggtcagga

SEQ ID NO: 461597 - DNA, 657 bp, Homo sapiens
tggcacaccgtggaacactatgcagccataaaaaaggatgagttcatgtcctttgcagggacatggatgaagctaggagccatcattctcagcaaactaacacaggaacagaaaaccaaacaccatatgttctcactcataagtgggagttaaacaatgagaacatacggacacagggaggggaacatcacacatgggggcctgttggggccattcacctttttgtttctcttttgcttcaagtctctgaaatatcagctgctttaagtcctcgtctgctcattcccacattcccactacatccaggatgccatcctgctgaaatgctgcactctgtcgttggagctgtgggtgtctctgaagtcctcctctcttttctctcatatggacatcagtcagatgtaagggctgctgagttttgcttggtcagcagtgaatttatcggtgggactggctgactttcgcaggcttccctgctttcaggaagctcctcagaggtgaatcagataatgaagcagaacaagatctgcccttgtgaattgcttatttgattgccatcatcttaattttaattttattataaagtgtgtaggcaacacagttgaagaaaactgtgaagccacaggagcctaagcaatagattcgattccttccatt

SEQ ID NO: 461598 - DNA, 2309 bp, Homo sapiens
ggccagcaccaggcagtggggacggagccccagtgcaggcacaatgtggaaaacctggagccgacacgacctgcaggacgcacagtggttctgcgtcatcacagacagcaaggggttcaggaggcggccggtcggcagcggacaggacatgccctcgctcgctctcggtgcctcctcggccttggcgcccactctggccgtgcttgaggagcccttcagcccaccgctgcactgtgggagcccctttctgggctggccaaggccggagccggctccctcagcttgctgggaggtgtggagggagaggtgcgggctgcgcgcggcccttgcgggccaacgcaagttcctggtgggcgtggactcggctggcccagcactcggagaggccggccggccagcccgcaagcccggggcagtgaggggcttagcacctgggccagcatttgctgtgctcgatttctcgccaggccttagctgcttccccgcagggcagggcttgggacctgcagcccgccatgcctgagcctcctccccctccccaccgtgggctcctgcgaggcccgagcctcccagacgagcgctgctccctgctccatggcgcccagtcccattgaccgcccaagggctgaggagtgtgggcgtacagcgcgggactggcaagcagctccacctgaggccccgtgggggatccactgggtgaagccagctgggctcctgagtctggtggggacttggagaatctttatgtctagctaaggggttgtaaatgcaccaatcagcactctgtatctagctgaaggtttgtaaacacaccaatcggcaccctctgcctagctcagggtttgtgaatgcaccagtcggcactctgtatctagttaatctggtggggacttggagaatctttatgtctagctaagggattgtgaatgcaccaattggcactctgtatctagctcaaggtttgtaaatgcaccaatcagcactctatatctagctcagggtttgtaaatacaccaatggacactctgtatctagctaatctagtggggacgtggagaacttttgtgtctagctcagggattgtaaacgcaccaatcagcaccctgtcaaaacggaccaatcagctctctgtaaaatggaccaatcagcaggatgcgggtggggccagataaaagaataacagcgggctgccgaagccagccgtggttgccttacacactatgcaagctttgctgtttgcagtaaaactggctgctgcttgctctttgggtccacactgactttatgagctgtagcactcaccatgaaggtttgtagctttactcttgaagccagtgagattaaaaacccaccgggaggaacaaacaactccagtacgcgccgccttaggagctgtaacactcacggcgaaggtctgcagcttcactcctgagccagccgcaccacgaacctatcagaaggaagaaactccgaacacatccgaacgtcaggaacaaactccggccacgccgcctttaagaactgtagaactcgctacagcactcaccgtgaaggctccagcaggccccacgaacaggactctgggccttatgccaggagggggaagattcaaagagggcccctcacctgggtctgacccaaacccacaccaaagccagcaggtcatccagagctgattccctgggaagcctgcccaggaaccaccgtccgtcgggctttcttattgtaagagcttttttttttttttcctcctttggcagagcacagcgctgggctccagccctgatgcagaggtacaaagctcgtctgggcagattgttatgcaaatcaaaagaggaagcagagctaggggagccgaggagctcctgctgggctctgccagggaagaagccgcagtaggagcccctacgtaggccctgcaagaggcctggtgttcaggaaagggcccgctgaccatccagtgcagggaaaggagtccagctctggcctctgcccctcagctccacctcctgcattcctaggagttctccagaggatctgatgggagctcagaaccggtcccaacagctccctccacccttcatgaacgggggctggaaaatgtggtctgctctgataaggatttgcgtcaggctactggctactcagcagccgagaagagcaagcctccaggcctctgcacgcgtgccttctgcccggtgagcctctcactatcgtccttctaaaagacacttcaaaaagaggcaaaatcatgccttccatacatatattaaaaaaagaatatgtgtcaaatattttattctactcct

SEQ ID NO: 461599 - DNA, 882 bp, Homo sapiens
tcagggcccgagggatgcatcactgagggagccacgactggtctctgggcctgacggtaaaccagggctgttaagtgttgcccaggtggccagcaagacaaataagtgcctcaagctaaggtaaatgaggaccagagagatgaagctcctggctcaagtggctcctatcccatgattccagctctccagcaattctcccccactcccacctctattcgattctggggccgaaagccagcaaggcagagccactgggaccttccctgcctgagaagcgcatagaagtaagaccctcgaacaggtccaagctgggcccatcacagaaaacagatgtccactgagggtccagcatcgggatttagggctattttttacaatgttactgaatgaataaattcccccaagacttacattttaaaatttaagatctttggtgacaatttcctccaactgctaatgacaattcagcggcaggtgaccatccttgctgggacacggggctcctggagcaagtcctgtgcagctgaagaggggagcgaatgggaactttggaaggaggaggaaacaggaagtccaagcgagctccacgaagcctccgggcaggaacgcaaacaggaaagcgaggtctccactctgggtacagtggccagatctgatgaccttagcaaagccgctcttggcctggagaatcttgcaagcttggactttctggggctcccagggagaactggggatcaatcccggtcagacaccatgaccctggtcaagtgcctccttcccacttatctcatacacaaaatgggaatggtgcctacagtagaggctttctgccaagatgacaagagccacttacacaaagagcatgtggtggacacctagcgg

SEQ ID NO: 461600 - DNA, 632 bp, Homo sapiens
ccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtctctgaagcacgtcggtatggggatccttctagagtctgtccctg

SEQ ID NO: 461601 - DNA, 1529 bp, Homo sapiens
ccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgctctcgcttcacgccaacacaatctccgccgccctgtcttgtcatccccattctacagcccagcacggtgtagtatggcagccgctagccacaggtatctagggagccctggaaatgtggtcagttctaatggagctgcgctgggtggagccctcatggagaaccactgctagggcagtgcaaagggaaattgtggggtgcaagccctcacacagactcccaactggggcagtgcctagtggagctgcaagaaaagagtcactgtcctccagaccccagaatggtagctccactgacagcttgcaccttgctcctggaaaagccacagacactcaaggcctgcctgtgaaagcagctgggagggggggctataccctgcaaagccacaggggcagagctgccaaggccatgggagcccacctcttgcatcagtgtgacctggacatgagacatggagtcaaaggaaatcattttggggctttaagatttgactgctgccaggcattgaataagtctcacaagatctgatggttttataaaggggagttcccttgcacaagttctctctcaccttccaccatgtaagacatgcctttcaccttccaccatgattgtgaggcttccccagccacgtggaactgtgagtccattaaacctctttttctttataaattacccagtctccgcttgcccagggttaaggtgagcccagtcagcttccaccagttacactcagtgacacaggtgcagtttgttagagttggtgcagttagattagttggaggtgggcccaaggactttggggatgcgggttgagggggtggggagtggggtgacaggtaccaaagggtagcagagggagggatggtagaggtgattggagagtgtgaccctcgaagtggatggggttatggcaatc

SEQ ID NO: 461602 - DNA, 1725 bp, Homo sapiens
ttggtagtaacaagagcacacaatgatcaatggttcccaagggggcatgcaattggcttgtttgaataaattcatgggctggcagacagaggagctctatggtgactttgaagacttggaaacaggggacgtgcacaagggaaaatcgggccccgatactcagagaaacaaggaagaaattgaccccgacaaagaagaaagtgccaagaaaaagcatttggataagaagagaaaattgaaggagatgtttgatgaggaatatgatgaaggagaaagcacatattttgatgatcttaaaggagaaatgcagaaacaagcacagctgaatcgcacagaatttgaagatcaagatgatgaagccagagttccatatgagggttttcggcctggggtgtacgtccgcgttgagattgaaaatgttccctgtgaatttgtgcagaactttgacccccattaccccattatcctgggtggcttgggcaacagtgagggaaatgttggagacgtgcaggtgggtccctttgctgcatatttggtgcctaaggctctgtggatttcccctccatcaatcatcttacactctcatccccctcagatgcatctgaagaaacatcgctggtataagaaaatcctcaagtcccgagatccaatcatattttctgtagggtggaggaggtttcagaccatcccgctctattatatcgaagaccataatggaagacaaaggcttctaaagtataccccacagcacatgcattgcggagcagccttttgggaaggagctttccgggccagctttgaggataagctgctgatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcctatggtgtcagactaaaggcaaataaggactctctgtataagaaaaaagaaaaaataaaaaacaaacccaagacccaagcaaaggacaggcggagactggccgtcatgcgtgagcctcatgaaagaaagatcctcacactgctggatgctctgagtatggtgcacagtcagaagatgaagaaggccaaggagcagcggcacctgcacaataaagagcacttcagagccaagcagaaggaggaggaggagaagctgaagtggcagaaggacctcaggaagaagctcttccaaattcaggggcagaaggaaagaagaaaccagaagtccagtttgaagggggctgagggccagtttcagtgagcctttggactggagggactgtccctggatctgcagaggtggacagtttcaaacatcacagtttgaatgcctgtgaatgacaagtcagtgggcaagaactcaagagatgtctctacacaaactgtgcctgcaagaggaacagagaagcctggactacttggaccgggttcattctcatcacttggggctgtcgagatttaaagtgatgtaagctgtggttgtgtggattctcttactttcctctgcctgcctcagtttaattattttgtcctgcaaaaataccattaaatttttttttgttagttttggcttagtagttttcattagggatgaatgcctgacaattctttgtggataattatttatgctaccaccttcatgaggagtcttccagaagagaaagaaatatt

SEQ ID NO: 461603 - DNA, 1759 bp, Homo sapiens
ttggtagtaacaagagcacacaatgatcaatggttcccaagggggcatgcaattggcttgtttgaataaattcatgggctggcagacagaggagctctatggtgactttgaagacttggaaacaggggacgtgcacaagggaaaatcgggccccgatactcagagaaacaaggaagaaattgaccccgacaaagaagaaagtgccaagaaaaagcatttggataagaagagaaaattgaaggagatgtttgatgaggaatatgatgaaggagaaagcacatattttgatgatcttaaaggagaaatgcagaaacaagcacagctgaatcgcacagaatttgaagatcaagatgatgaagccagagttccatatgagggttttcggcctggggtgtacgtccgcgttgagattgaaaatgttccctgtgaatttgtgcagaactttgacccccattaccccattatcctgggtggcttgggcaacagtgagggaaatgttggagacgtgcaggtgggtccctttgctgcatatttggtgcctaaggctctgtggatttcccctccatcaatcatcttacactctcatccccctcagatgcatctgaagaaacatcgctggtataagaaaatcctcaagtcccgagatccaatcatattttctgtagggtggaggaggtttcagaccatcccgctctattatatcgaagaccataatggaagacaaaggcttctaaagtataccccacagcacatgcattgcggagcagccttttgggaaggagctttccgggccagctttgaggataagctgctgatgagcgatattgtcttcatgcgaacttggtatcctgtttccatcccagccttctataacccagtaacatctttgttgaaaccagtgggtgagaaagacacctggtcaggaatgtggaccacgggccaactcaggctcgcctatggtgtcagactaaaggcaaataaggactctctgtataagaaaaaagaaaaaataaaaaacaaacccaagacccaagcaaaggacaggcggagactggccgtcatgcgtgagcctcatgaaagaaagatcctcacactgctggatgctctgagtatggtgcacagtcagaagatgaagaaggccaaggagcagcggcacctgcacaataaagagcacttcagagccaagcagaaggaggaggaggagaagctgaagtggcagaaggacctcaggaagaagctcttccaaattcaggggcagaaggaaagaagaaaccagaagtccagtttgaagggggctgagggccagtttcagtgagcctttggactggagggactgtccctggatctgcagaggtggacagtttcaaacatcacagtttgaatgcctgtgaatgacaagtcagtgggcaagaactcaagagatgtctctacacaaactgtgcctgcaagaggaacagagaagcctggactacttggaccgggttcattctcatcacttggggctgtcgagatttaaagtgatgtaagctgaagtggcagaaggacctcaggaagaagctcttccaaattcaggggcagaaggaaagaagaaaccagaagtccagtttaattattttgtcctgcaaaaataccattaaatttttttttgttagttttggcttagtagttttcattagggatgaatgcctgacaattctttgtggataattatttatgctaccaccttcatgaggagtcttccagaagagaaagaaatatt

SEQ ID NO: 461604 - DNA, 526 bp, Homo sapiens
  misc_feature (347)..(347): n is a, c, g, or t
  misc_feature (382)..(382): n is a, c, g, or t
cgaatcatatggggatttgccctcgaggcaagaattcggcacgaggcaggaccgagcccactcatgcaccactatgggaactctgatattctggatgtcacccagtgatacccactgccctgacccctgggcaggcccctctctgcatctactggagtggtccctgggctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggcatnttcatcaagcctagtgtggagccctctgcaggtcncgatgaactctgagtgtgtggatggatgggtggatggagggtggcaggtggggcgtctgcagggccactcttggcagagactttgggtttgtaggggtcctcaagtgcctttgtgattaaagaatgttggtctatgaaaaaaaa

SEQ ID NO: 461605 - DNA, 1641 bp, Homo sapiens
ctacttgtcctgcatctaatcctctgtcacatacctcatctcaacagccaaatcagcaaggccaccagacctctcatgtctacatgccaatcagttcacctactacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtacctatgttttgg

SEQ ID NO: 461606 - DNA, 2807 bp, Homo sapiens
cttctgctcctggtcctggccatcatgtatgtcttcgcctcccaccacttccgccgccgcagcttccggggcttctggctgacccaccacctctacatcctgctctatgccctgctcatcatccatggcagctatgctctgatccagctgcccactttccacatctacttcctggtcccggcaatcatctatggaggtgacaagctggtgagcctgagccggaagaaggtggagatcagcgtggtgaaggcggagctgctgccctcaggagtgacctacctgcaattccagaggccccaaggctttgagtacaagtcaggacagtgggtgcggatcgcctgcctggctctggggaccaccgagtaccaccccttcacactgacctccgcgccccatgaggacacactcaacctgcacatccgggcagtggggccctggaccactcgcctcaggagatctactcatccccaaagggcaatggctgtgctggatacccaaaggtgcccgtcactgggaaccatgcttccgggcttctggcactggcagaggatctctgcctttccctatcctgagagtagaagctccagccgtcccaaagccagcctgggagaggaccggggtgcctcagaaaagactaggatgttctgtatcctccctctgcctgtgtctccgtttctggtctcagagctggggcagggtcaggctcatttcatctcccccctctcttggcagctgtaccttgatggaccgtttggagagggccatcaggagtggcataaatttgaggtgtcagtgttggtgggagggggcattggggtcaccccctttgcctccatcctcaaagacctggtcttcaagtcatccttgggcagccaaatgctgtgtaagaagatctacttcatctgggtgacacggacccagcgtcagtttgagtggctggctgacatcatccaagaggtggaggagaacgaccaccaggacctggtgtctgtgcacatttatgtcacccagctggctgagaagttcgacctcaggaccaccatgctatacatctgcgagcggcacttccagaaagtgctgaaccggagtctgttcacgggcctgcgctccatcacccactttggccgtccccccttcgagcccttcttcaactccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttccagtatcctgccttctcttctgtgcacctaagttgcccagccctgctggcaatctctccatcagaatccaccttaggcctcagctggagggctgcagagcccctcccaatattgggagaatattgacccagacaattatacaaatgagaaaaggcaggagactatgttctacaattgcagtgcatgatgattataagtccacctgtttatcaacggcaccattcctgcagccctccagacttcctgcccttagcaagtgcgcaaccagtcaggatctcccaaagaagataaagaccactcctcaccccagctcaagccatggcaggcgtggcaagcaaagtggggaggagacagtccctgcttgtgacaagtgtggaggtgaaaaggtacaatagtgcttgtctccgatagctccccacatctctaattgacttccacaaaatcgatgcgttgctttggtatttgcttggactgacatttgagggaggaggaggctgggatcctctggctgagaatctcctcagagcccagtgcagaagctgtgatgcttagaacctggacagcccgactgcctcaactctgtctccaggtctattccctccagctccaaaaggagcagccctacttctaccccttcccgtccccaaagtgtcagcaactttgaggagggcaccaggaaacaaagatgcctccccagccctgatattcttgatgtcaccagtgatacccactgccctgacccctgggcaggcccctctctgcatctactggagtggtccctgggctctggggctgaaggattccagcctctctgccagatattcagtactcgatctcaattcccctcttccacaagagttgggtgaccagctgtcctagtttgcccaggactctccctgttttagcactgaaagtctcttgccccaggaaaccccatcagtcccaggcagattgggacagctggtcaccttacgcaagagccaggctgaaacatcccctccatactcagctctttaacttttcttttcctttttcatcgggctctttcctaaaaagctgagctgtaaaatattttacatcgaggtataataaataatcatgtacatgttttaccaccacccaggtcaagacatagaatgtttcaacatttccatcaccccagaaactccccttgtacccccttccacttcgtctcccctagctcctagaagcaaccactgatgtgatttctaccaaatccagttttggtcctactaaatatactcttttgagactggcctcttttactcaccataatgcctttgtaattcatccatgctgttgtgtgtatcagcagtttgttccttttcattgctgagtagtattctattgtagagatgtaccacagtttgtttattcttctgttgatggacgtttgggttgtttctaattttgaatgattataaataaaaattctgtgagtgttcttgtacctatgttttgg

SEQ ID NO: 461607 - DNA, 1707 bp, Homo sapiens
gaaggatttgaaatattttgagaactctgaaataatgcacaccagaaacgtccagctgaaaacaaaaagggaacaagatgacattttgcaatcccatgcacgttgcaggcacgttgaatgtgaagctttcttgccggcctctcctcgcagccgctcccttccacacctgccttttcacctgccagactgcgcgttgcccgttgccctaggtctgcgtgttcagcacttctgcaacagtttcttctgcaaaggtaaggtagacagctgtaaactggatcccctgctgtacccagcaaatgctgagagccctgcttcccctcttgtattcaaatggctctataagagaggaagtagtacagctatcagtaacaatgccatccgtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaagaaaaatggatataaacaatattgtaaatcatatttggaaaataaatattagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaatcctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgacattttggcatgactggactcacaggtggagaagtgttgtcttttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctc

SEQ ID NO: 461608 - DNA, 1505 bp, Homo sapiens
ggaagacaatttttccacaggcggcaagggatggggcacaggatgctaatggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461609 - DNA, 607 bp, Homo sapiens
ctgatcagaggatcccgaaaatgacatagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461610 - DNA, 374 bp, Homo sapiens
tctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgggttatcaatactctggctgaccatcgtatcgtgggactgactttggtggaagtccttggttacttatcattactgtgtttctg

SEQ ID NO: 461611 - DNA, 471 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (420)..(420): n is a, c, g, or t
  misc_feature (426)..(426): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangcaggttatcaatactctggctgaccatcgtcatcgtgggactgactttggtggaagtccttggttacttatcattactgtgtttctgagaagttataaatttgccatctccctctgcacaagttacctttgggttatcaatactctggctgaccatcgtcatcgtgggactgactttggtggaagtncttggntacttatcattactgtgtttctgagaagttataaatttgccatct

SEQ ID NO: 461612 - DNA, 1261 bp, Homo sapiens
agaaacatatccatataggtgtgtatctctttcatatccaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461613 - DNA, 1190 bp, Homo sapiens
tggaaggggagtgagcagacactcgggaggtgtcttgagattatcatccgctgagggtggaaggggatagagcagacgctcggaaggtgtcttgaggctcagggagttatcaattatagaatgttgttgagttggaggaggtggctggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461614 - DNA, 1426 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (1195)..(1195): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461615 - DNA, 1701 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461616 - DNA, 1280 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactcccccttcacacctag

SEQ ID NO: 461617 - DNA, 1382 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (1151)..(1151): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacaggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461618 - DNA, 1310 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461619 - DNA, 808 bp, Homo sapiens
  misc_feature (577)..(577): n is a, c, g, or t
aatccgcttagtaactctgaggtataagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461620 - DNA, 1166 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccatatttgtaatagcaaatgggccctgactgtaaattagt

SEQ ID NO: 461621 - DNA, 614 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacagatgggtgccgagctcgattc

SEQ ID NO: 461622 - DNA, 836 bp, Homo sapiens
  misc_feature (605)..(605): n is a, c, g, or t
gaacatgtaccagacgatataaaatattaacatagtcgggcctagtctgagaactaatatgattgacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461623 - DNA, 1637 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461624 - DNA, 1326 bp, Homo sapiens
gtcaactgcatgtcaacctgaaagcaaggaagtaaaaagaatttcagttattttggaggtgtttcaaaagactgaagatcactaccctagagaaaaatcacacatgtatgcaaaaagagataggtaaagaatgttaattgggccgggcatggtggctcacacctgcaatcccagcactctgagagccccaggcaggcaaattgcttaggccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagaaactaacgaagaataaataaataatataaaaataaaatgaatactgcagtccttatgttattgctttgtttcaatatctgttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatc

SEQ ID NO: 461625 - DNA, 1490 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (1259)..(1259): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461626 - DNA, 1306 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (1267)..(1267): n is a, c, g, or t
  misc_feature (1273)..(1273): n is a, c, g, or t
  misc_feature (1280)..(1280): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgtcnctcccntcccctnccttctttctcttctttcggacaggc

SEQ ID NO: 461627 - DNA, 1087 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttctgtcgt

SEQ ID NO: 461628 - DNA, 1340 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
  misc_feature (1109)..(1109): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461629 - DNA, 836 bp, Homo sapiens
  misc_feature (605)..(605): n is a, c, g, or t
tgttagtttagtgttgtaggatacttatgatgtgggggttttgtgctgagaactaagctgtaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgntcactccccttccaccctcagctccaccctcagtggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461630 - DNA, 1096 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggatgataatctcaagacacctcccgagtgtgtctgctcactccccttccaccctcagcggatgataatctcaagaaactaaggaagaataaataaataatataaaaatacaaacaacaccccccccaacagaaaaaaaaaaccaaccctgccccactaccctgacacaaccccaccatcaccaccacaaatacata

SEQ ID NO: 461631 - DNA, 583 bp, Homo sapiens
  misc_feature (215)..(217): n is a, c, g, or t
  misc_feature (222)..(222): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (232)..(232): n is a, c, g, or t
ggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgactnnnttctnangnntcnangagtgaccttgaggaaccctgggagctcaggaaggaaggagcgcccagaagcagggacagggagctggttggggaggaccagaaatcaggttatcaatactctggctgaccatcgtcatcgtgggactgactttggtggaagtccttggttacttatcattactgtgtttctgagaagttatagagatggcagagaggaaggctgcctacaagcatcacagtcccatccctgttggtaaccgtgttgcgcaaaaacaccttcatccccacccagtggggcccccatctaatattctaagtgtcagaggttccatatttgtaatagcaaatgggccctgactgtaaattagt

SEQ ID NO: 461632 - DNA, 765 bp, Homo sapiens
  misc_feature (1)..(2): n is a, c, g, or t
  misc_feature (6)..(8): n is a, c, g, or t
  misc_feature (11)..(12): n is a, c, g, or t
nnctgnnnctnncaggaatcgtaccggaggcaccggcacatgtggatctggtttagacgatgcgatctggcccttgaacctgagccagatgagatgatgaaggaggctttggggagtctggggagtcacagtcctcagatggctgaggcaccagacatgcccgtgaccagctttcagatgattccagccaccttgctgcatgaaggaccgagagtgacaactgctccagtgatctctgttgacacccagagcctgagagggataatatgggccgcaaatctaacatggaggcctgaaagtaggaacagtggcaacgggacactccccgctttctcagggagggtgctggtggctccctcagatcctgggcttctcctggtatatgtggcaccgggggagaatgcctcatatctttggaggtcctgttctaatttatatctaagcccacgtcaatgtccactttgaagactttcctatggacgatctcatctaatgtcgttttacagattttcttgttgtccttatcaccaggactctaaagacaaacatttggactctcctccccatagtcttaggaatttctcctctgctttgatctaagcattgttgaaacatggctgatatactaagacagtaactttttgtaagtgaaaaatatcctaaaggtctattctttcttaatgccactaataaaaagcactttgaagagtgtacagcatggtgacaatagttaatgacaatatattgtattcttaaaaaatgcta

SEQ ID NO: 461633 - DNA, 1813 bp, Homo sapiens
cttgacagatgtacgttggctctgcccagaaaggcgggacgacttcaaggtgaggaggggcttcctggtcacaggtgggttcaaagactttctgattagcaattggttgagagagttaagttattatctgatcacctggactcaatagaaaggagtgtctggattaagataaggggctgtggagaccaaagttcttattctgtagaagaaatctcatagggggctgcccttcgaggcaatagatggcaaatgtctcctattgagacctttgaaatgtgctagacgctaagcccatctctccagcatcagaaaaagccctggaaagggaagaggattctctacagaatgtggattttccccacaagagacagctttgcggggccgtttaaaattatgtcaaacactctattccttccaggacctgctccctgtcatgtgatgttatactagactcgggttggaatttggtgtcttattgctacaaacagcctgtgctgtcagtcttaaactctcggttttaatatgaatcatggcacacgatccccattacagtatcacagagcagcttcctgggcccctaaatcctccatgctcctgccacgcaccctccctgccctccttgctcctgccatgcaccctccctgccctccgtgctcctgccactcaccctccctgccctctgtgctcctgccactcaccctccctgccctccgtgctcctgccatgcaccctccctgccctccttgctcctgccactcacccttcctgcactctgtgctcctgccagtcaccctctgcccagccccggcagctgctgatctttcttgttttcatggttttgccttttcctgaatgtcatggagttggaatcacacagtatccagccttttccaatgggcttcttcacctagcagcatctaagattcctccctgccttttcacagcctggcagttcctttctttttagcactgaaaaatattccattgtctggagggaccccagcttatcctctctgccatcggctattctctggggtttttctactggtcctactcgtttttgttcattttacaatccagagttgtgagttgggtagatcagctgggaaaaaatggaaaagtagttgttttaattatttcccctttatgtggttaaaaagaagatgaagaagattctttaagttctagcattgactgttgaaagccacttgtataaaaggtgccaagaactacaggattctttcatctactgctttgcttcagagatcatctggcagccagcatggtggatcacgcctgtaatcccagcacttggggaggccgaggtgggcagatcactcgaggtcaggagttcaagactagcctggccaatatgatgaaaccccgtctctactaaaagtacaaaaattagccgggcatggtggcacatgcctgtaatcccagctactcaggaggctgaggcaggagaattgcttgatcctgggaggcggaggttgcagtgagccaagattgcatcattgcactccagcctgggtgacaagagtaaaactctgtctcaataaataaataaatacataggctattctagatccctttgcatctctgtataacttttagaaacagcttatcaacttccaccaaaaaaaaaatcagctagagttttgattgcaaatactttgagattacagataaattttggggaagattaacattgtaatggtattgagtgtttgaatccatgaacatggtatacttctccatttatttaggtcttatttaatttctctcaataatgttttgacattttcagtgt

SEQ ID NO: 461634 - DNA, 2454 bp, Homo sapiens
agttcatcaccatttcccctcgcaagaggatagactctacttaaaactctcagaaatttacatttcagtgaatataaaatgtggagtaaagtggagacgtatgaaccatgtgatgggcaccttgagcgcgaaaaaggcagaagacttgaaattggcctgttcactctttcagctaaggctgcagataaagctctggatgccacaggtcctgggtggggcctgaggcattgctgtgctagccagatccctggcgatgttggtgtcgctggtgttccagggacacatggcctatgccatacatcacagtaccaccagacgctggcacgtgtgtacacatcatcagaaacaggtatcacaagttcctgcctcaaacgggacacacaggccactcttctttgcctacccacaaaacttctttcaccccgaagttctcgacatcttcttgaactatcagtgaaaagtaccactgggaaagcctttctgcacagagccacatcggtgcagtgcccctctcgactctcccagtgctgtgtgagtgcctgtgttccgaagcagcacccctggtatcacatggaccgactctgacagatttgtttcttcattcgtcatccctccagatggctttaaaatgaatatagcattcaaataactacacagaagaaatcatcctataaccagttgatgcatataaaatgtgtgaaaatcagattataccacttatttttccacttagaattagcttcagaggttttcattttacataaatgatataacatgaaaaacaagcatgttccacaggggcctaactgctgtccagtcactcttctgtggcttggagaaattcgggcaaatagtctttgattaactatacacagttccagagggatcctttccaagttaccttaagatagcactgaatttaaaatgcatatgttcagataaggaaaatacctgaataataacaataatgaaacaaatagcagatggttaataactactggcttaatttaacttgttttcaaaccaggaattaattcaaactatttggatatttttccatagtgagactgagtaagcttcctccttcagattgttatttaaagttcaaatttcattattagttaaaaaaaaaagaaaaggaaaaaagataacaaagaaaaagattgggtggcacagacaattaaatcattactcatcaatgccaaaattctaggttctttgttctttgtcatagacagatgagtgtgcgagtgtcaatccagtcttccctccctgttttacttagactgggccacttttggacctattcagcaattctgaatcatcagctcatgtcatttctaaagccaagtccccatcctttgactcatcaattatcatatatttttactcatagatattctccctatcactttttaaagatgcaatttatgtctactttccagtaatcgtcatatttttatcaaagcttttagctaccatttgtttttgccacctatgcacttttggtggttttacagcaagaaacttccaaataatttctggtgtcatggactgcgtggtttcccattgttgctctaatctgcccttctcacttcaaacctctacttcctaaaatgagtcaaggatggactctgatgttgttgaaggtgagaagcagggcaaagagaaacagaaaaaaaggggagctgactgagacgtgaacgagctggggaagtccaggttgaacatgcacttatgagagaccaactctgcacaaagaaatcaaccttagttcttcaattttggctcctctgactcctgctatgggtaaatatgacaaaatgctttactgacaaggtttgataatgtctgagtggttaaaaggtgacaagtgatataactgtacaatgtgttcaaatgggaaagaaactgaattgggaatctgaaaactgagatttaggtcccactttgtaaccagtttgctatgatgcccttggcaagtcacctaacaagcaacgctctaccctccctcagagctgcctgtttgcgtttctccggacaagacataaattctattctgtgttacaaactctgacctctcctcaaagtgtgtgagctcgcccagagtaaggggacatctttgtacattttatggtgtctcctagcttgccttcgaatgtagcaagtttaaataactgatagccaagaaatggggctgtggagcaggagatggtaagtcgcatttcttgagccctgaatgaatgcaaagggcttttcatatcacctcacatcctcctcacagacacaggcctggatgacaatcgtcttttgatagtgagacagataatggttgtagacattcattcacttacacaagttcacagggatgctgttatgggctgaactgtgtccccccgccaaagataagtgaatgtgatgtttagggtctttggagagtactcaagttaaggc

SEQ ID NO: 461635 - DNA, 660 bp, Homo sapiens
  misc_feature (3)..(4): n is a, c, g, or t
  misc_feature (7)..(8): n is a, c, g, or t
  misc_feature (11)..(11): n is a, c, g, or t
  misc_feature (13)..(14): n is a, c, g, or t
  misc_feature (16)..(17): n is a, c, g, or t
ctnnctnnccntnncnngagctcatggtcccagtggcaggacgtccgttatgcaggtccagcagtatggagttgctcctgctcctgcccctccacatccccagggaacagatgcttctggcaggggctatggccaagttgctcagagcttcctgggttgtgtctgtgaagagcctgctgcctgtcgggtgttggtcccagaggtctgagctggggtgggtggggtccatgggccatggctgctcctcagggatcctgcagatgctgagtggatggcatcccctggcagaggtcacactgagaggaggtgacaggggagcctctccacctggagtcacaggctgcaggaaagaggagcacacttcacaatataaagccacccccactgcaacttgggcccagaaagcctgccaaaaccagggatgctgctccaggtcctgttacatccactctgcagaaaagacacattcctcagtggattgactgccccaggagcacagggacctggcagttctgaagggccgcctgaggaccctaagcctccttctgcccctccctcttcttcaaggcagctggcaacctccctctctataaaaaagaaggggaaatgcatgaacacgtggaacgtgataaaatacgctgtttatttccatgtgattag

SEQ ID NO: 461636 - DNA, 1642 bp, Homo sapiens
tttcacttcttttgtgattcttcagttacttcaggccatctgggcgtatacatgcaagaccttcttccctgggagaagggctggggtcaatcttggccgaccactgccacagggaccaacttgcctttatgttgccagagtagcaggctcaaagctcgactggagggtaggtccttgtgtacttcagattatgatccatctattatctatctatctatctatctatctatctatctatcatttatctatctatcatctatctattatctatcatctatctatctatcatctatctattatctatcatctgtctatcatctatctatctatctatctatctatctatctatctatctatctatctatctatctgtctttactgccatcaatacaatgactgcttctcattctaacactctagaccctggagtcaaatccagctcttccactaaccagctgtgtaaccttgagcaagttcttatcttttccacatctcacttttctcttctgtaaagtgaggatgataaccgtatctaccccatggagttgtttgagaattttaagccattcatgccctactcctagcatgtgtttggtgcacagcgagcactatagtaactattgatgttgttaacacattatttccttcctattatccttaagagggagttcttaccttctcatcccatctctttagttttcttaatataactctaaattaaaataaaactcttcactttgttaggaagaggaccatgacttgcttaggcccgactaacatttgcactcaccattttgttacacagatggcaaaccaggaaaacagagctcagtacagaagggagttgggcagcctctgttcctgtttggctctgtccttgaagaaagtgataagaagtgcacagattttggaattaaacagaccatggtttgaagtctggatcttccagttgtaaccaggtggcattgggaggcgaggagagaatggatcccggtctgagctccccgcttccgtccccagtctccagataccggtcctcgcctctccgcgccgcgcgctgcctcctctccccggtgctagcagcggccgctggcatttggaattctgcccacaaaagggggcctggaggaggaggagaggagggacggaggccggcggcgagaaacggcattcggagtccaaaacatcatgggaaaaggaaccgagcggcggcggctctgaaggctgtgccgctgcgcccgaccgcagtgcatcagcgtggccgccctgacatcccccaggatggttaacatggggcattatgcgctggttaacaggctccgagctgctcagcgacttgttttaagcattttctctctcgctctcgcttttaatcttgtctctagtggcgtgtgtaggggggaggactttatttccattggctaagctctcccttcccacccacatctcttccacatcaccttggtgtctccctaaataaaaccagccctccttatcgcctggaaaaaatcaagagctagagtttgaatgggttttatataaacactcacccctgtcagcgtgcggctgggctctcaggataaactcacagcatctggcgcgatgcttgccttgcgttctctcccctgaacgtcaaggttt

SEQ ID NO: 461637 - DNA, 5857 bp, Homo sapiens
tcacctgtcttctgcgtcagtcatgctgggagctgcagactggagctctgtaacccatgctggtgatgtttgcaagtgtctctgtggcctaaggtccaaggcgcaggtatgcagccgctcagctggcctgggggtgtatctgccaggagctggcctgagccagctgtccctgagtgctggcaaatacactgacctgaagattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaacatcttctaatgctgcatcaaagctgccctgaagctgcactgaacttctcttgttctctttatctgtgttgagctttttaaaaaaacaaactcaaaacactattgaggcatataacgtctcttataagaaatgtagcatagtgtggaatcttaatttctctccagtttcaaacactccagaggaatgcaatagataagacatacttgctgtttatctaaagcaactgtaatattggaagatcagtccttctgtattatattgtataatagttgctataacactacttgcatgtcttcatggtaaattatataaatatttataaatatatagagagacatatccttatatagagtcattctttgtcattctccatttgtaatttcgagatcacagatggcgaaattccttttctattgtgtgcctcatgtacacttgggccttgcctatcttcattttctgaaactatgttcttggcatgtgacacctcagagtcttcttgccttccctgtgtacaatgcaagggtgggcagtatttaacaagccaagataggttatttaattttcatttcaaaaagattttaatagggaaaaaattacagggacatgcttgtaatactggttcagagatttgtcatgttaatcacatagttctctccttatagttagagtggataaactgggatgatgatgagtctgacagatttttaaaacatttcttaaaaattgccattctactttcctcttttcatctcactttttttgcagggggtcgggggaataatgaagaaattgtcatatttctgttgcattagctaaattgtgctaaaagtagctagctttaaatcctgacccctttagtcggaaatatgctagtagtaatcattggaaaagctgatgaagctacaactgtggtacgtgtgtgtgattttatttcttattggcatttctctgctggcagttggaactgacagtgatgggaatgtggcaactgaatgttttctctctttcttggttccttccatttttatctcaacttttctagtgtgttgtccccttttctaaatggcattgacaaactcatcaagatccagagataaacagtccatcgtttaagaatattttattttgcatgtagaggaaagaattaaccaaagacgtttctgctctgatactttctaaagaaaacagactaattatatataagtggtatcaatagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaatctagttctgtttgtgtgatggtctggatttcaaaag

SEQ ID NO: 461638 - DNA, 5676 bp, Homo sapiens
  misc_feature (27)..(27): n is a, c, g, or t
ttcatcggcacctcgctattcatcgcnacctcgctattcatcggcacctcgctattcatcggcacctcgctattcatcggcacccagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaacatcttctaatgctgcatcaaagctgccctgaagctgcactgaacttctcttgttctctttatctgtgttgagctttttaaaaaaacaaactcaaaacactattgaggcatataacgtctcttataagaaatgtagcatagtgtggaatcttaatttctctccagtttcaaacactccagaggaatgcaatagataagacatacttgctgtttatctaaagcaactgtaatattggaagatcagtccttctgtattatattgtataatagttgctataacactacttgcatgtcttcatggtaaattatataaatatttataaatatatagagagacatatccttatatagagtcattctttgtcattctccatttgtaatttcgagatcacagatggcgaaattccttttctattgtgtgcctcatgtacacttgggccttgcctatcttcattttctgaaactatgttcttggcatgtgacacctcagagtcttcttgccttccctgtgtacaatgcaagggtgggcagtatttaacaagccaagataggttatttaattttcatttcaaaaagattttaatagggaaaaaattacagggacatgcttgtaatactggttcagagatttgtcatgttaatcacatagttctctccttatagttagagtggataaactgggatgatgatgagtctgacagatttttaaaacatttcttaaaaattgccattctactttcctcttttcatctcactttttttgcagggggtcgggggaataatgaagaaattgtcatatttctgttgcattagctaaattgtgctaaaagtagctagctttaaatcctgacccctttagtcggaaatatgctagtagtaatcattggaaaagctgatgaagctacaactgtggtacgtgtgtgtgattttatttcttattggcatttctctgctggcagttggaactgacagtgatgggaatgtggcaactgaatgttttctctctttcttggttccttccatttttatctcaacttttctagtgtgttgtccccttttctaaatggcattgacaaactcatcaagatccagagataaacagtccatcgtttaagaatattttattttgcatgtagaggaaagaattaaccaaagacgtttctgctctgatactttctaaagaaaacagactaattatatataagtggtatcaatagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaatctagttctgtttgtgtgatggtctggatttcaaaag

SEQ ID NO: 461639 - DNA, 3454 bp, Homo sapiens
gtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaaca

SEQ ID NO: 461640 - DNA, 1112 bp, Homo sapiens
gccaagatacaccatttaatcttttttttttttttttaattgagatggaacgccagttagtaaatcttcccatgctatatgacagccagtcctggagaagaagaaaatcacctatcccaggaaaagtggctctacacctatttcaacctcaagtcttccggccttcatctttctcctgtgctggatgcttcttgtcctcaaacatcagactctgagttcttcagcttttggactcctggacttacaccagtggtttgtcaggggctctcgggccattggccacacaatgaaggctgcactgtcggcttccctacttctgaggttttgggactcagactgatacactactggctttctcgctcctcaacttgcagacagcctattgtgggattttaccttgtgaccatgcttggcacaggtggaggaattccactgcagaaaaccaagacgaataatgcttctgaaaacttccgaatggtagatagagatctgaaagagcgcagacacatgaccccaaaggacatttgctgagtgctgaggcagtataggaagtggggtgtttatctgttcagggtgcttaggtgacaaaatccttctataaatacaacagatttgcaaggttatgaacctgtttgggtggaaggttaaagggcttaatttaaaggatccaaaagatacacattatattactgaagaagtagagactcattagacttttcatcaaaaccctggtaaagccacagtcaaaaaggatggggctgaaagggagagtaaaattttgctcaatttcttggtacttaggataaaaggtcctgttttaaaccatggctcatctcttcctcaagatgtttgacagatattgaagctacatggggctggaggctaaatagttaagctcaaactcagaaaaattgaattgaagggtttaaggtctgaggagacacacatctaccaagatcacaatcagaagatcagcgatatagcagaggtgggctgaatctatctaaaactacaatccagttctgaccaagctcaattactgattagatttaaatgacctggccagccactgtggcttatgcctgtaatcccggcactttgggaggccgaaa

SEQ ID NO: 461641 - DNA, 692 bp, Homo sapiens
agcgcagatacgactcgagctcggacccggagacaacttacgacttctagtctgtccacatctggagcatagtcatgcatagctgggatgctactgtgtgctgaacattatatttaagaaatgtctttgatcccatgtgtaaggaccccatctaattccttgtctccttgtttcctaagtgctgatagcatcatcattgttctactactgctgtgataataatgaaatgtttccatttttacatattctttgctttattcactcctgtggtgtgtagggtcattattcatgtggttgcccagtgccatgaggaaggattggagagccacttgaggtcatatgttaaggtatgtaaaacacactgttctgatcacttacatctgtggctctccagttttccttctaaggacttattttttcacaagcctggttatttgaggatgtgcttgtaacgtatgctttctcttctatttctcatagccaatgcttgtacctgaataggggaggtacgaagagggacagccattcactaatttacttaattccattccttcaattatgtttcttttaatgggttttccaaataatatgactcaatgtggaagtttaaagaagaattttaagttgttcttggctaggcctctgctaacgtaagtgtctccgggtccgagctcgagtcgtatcatgtactt

SEQ ID NO: 461642 - DNA, 1775 bp, Homo sapiens
  misc_feature (880)..(880): n is a, c, g, or t
ctttacttctctgagcctctgttagctcatctgtaaatggggactttcttctgccccagattatggtgaggattagatggcacaatctatgtgaaattgtgagagcacgtagtacagtgcctggcacacaacagattctcagtctatatgccatgtcattcctgcctatcattgttcttggcaagtgtagagtgaaagcctgtggccatacatcttcatgagccatcagcatccccatagccaccgtctctgcttatctcaggccccaaagactctggctttttccctaagagaaacctctttacctatttctcaacctcagtgtaaaatataagaatgcaaaaaaggttagctattagatgatagaactcaaacgatggtaatactaaactgttaagggttcacacagaggtttaaatgcacataccattgggtacagctgtttcgcttcagagaacttatcctgtaggtatagttagacatgcatgcaaagacccacataaaaggatgttcattgaaacataattataatagcaaaaagttaggggagagaaacagtaactgcctatcagtaggagactagttaactcaattatggtctatccacatagaggaatattacgcaacttgggaaaacttgagatagatccaagctatattgttcagttaaaactcagagagcaaaattatgtgtgtaatatgcaaagattttcaacaaattccctgttggggagagatcctgtagtaggagacaagagagcccggctttaggttatatgtccacttgtattctttgaattttctagtctatttaagagcatgttacgaataagttaaatgagcattatgccagaatatagcactaaatgacgtatgatgnaattaaagttcaaatgcagcatgttgaaggtgaataggcctcaggtgtgtgatacccagtgtagagtggtcagctataaaagagggcaggggaagggtttagaggcctacactccagggtttagaggcctacactccaaggttccttcccattttcacaacaggtgattctccataatgtatatcatatgtattgtgattctaagtaaatgtttattttctagatgctttgtttacatattggaacaaggcttcaacatctgaacttatggatttttttacaatatctgagtaagtagctttctctttgatcactgcctcttgattttttcctggatcattaagaggcttgaagaatactatgtagttgaaccagaggagtagtgtatgtcacatcctcacttactccttaagccctttctcatggtcttggccctaaaacatattttcagggcttgtgacccagtgatcagtggtcacccttaaagtattacagatacgtgcctgttttacatgagaggtaactgtttatgtgtataagtcatcttaataaaataacatgaaatttattaggctgaattggggtagatactgcttttctaagttgaacctaacttaagctgatgcagaaactgagtcagaaaagttgctataattttaaaatataagaagtaaaagtgaaatcttatgtagcatctttatctcattttggtttgtcagtataagtttctgatttcctttaagctctttacttttagaaacgtgaatttacaatcccttatccaaaactgctggggccagatgattttccaaattcagaactttttggatttctgaaaaatttacatatagactgtatcccattacatcccagcagcatctctctataataataa

SEQ ID NO: 461643 - DNA, 320 bp, Homo sapiens
tatgaggccaacgaaggccatttgtttattttttttttgtgtgtgtgtgtatttttattcaagttcaaggacttttcacctccattatcacatttgttattttaaaatcgattctcctctttgcacatgggaagaaatgggctttgttctgttttccagaggctggcccatctgtatgacacgctgcaccgggcctacagcaaagtgaccgaggtcatgcactcgggccgcaggcttctggggacctacttccgggtagccttcttcgggcaggtgagcctcctgtcctatctgcagactgtcgtaagtcctttaaaaaa

SEQ ID NO: 461644 - DNA, 476 bp, Homo sapiens
aggtggatggatgctcttcctcacttctagtctgtccacatctggagcatagtcatgcatagctgggatgctactgtgtgctgaacattatatttaagaaatgtctttgatcccatgtgtaaggaccccatctaattccttgtctccttgtttcctaagtgctgatagcatcatcattgttctactactgctgtgataataatgaaatgtttccatttttacatattctttgctttattcactcctgtggtgtgtagggtcattattcatgtggttgcccagtgccatgaggaaggattggagagccacttgaggtcatatgttaaggtatgtaaaacacactgttctgatcacttacatctgtggctctccagttttccttctaaggacttattttttcacaagccaaagccaaaggcgcggtcaaagaacttgaagagctgctggatgctctcaaggatcgccaagccgaaacc

SEQ ID NO: 461645 - DNA, 548 bp, Homo sapiens
ctgtctttaatacatggttattaatatccttccatcatgtctaataataaattccattcgctgtgatttttcacacctctttttaaaatacaggccaacagtaaaggcagtgttcccaatgcattgtattaataatagttcaaagtaagacacctgaggaaccaaaacaaagcagcttcccacacctctgacccagcaacgtgggcattatgaagattgtccgggtgcagtttaagtgttatgaagattggctgggcatggtggctcatgcctgtaatcccaacactttgggaggccaagctgctggtggccaagcagcaggtggatcacttgagaccaggagttcgagaccagcctggccaacatggtgaaaccccgtctctactaaaaatacaaaaactagtcaggcttattggcacacacatgtaatcccagctactggggaggctgagacatgaaatcacttgaacctggggggctgaggttgcagtgagctaagactgtgccactgcactccagcctgggtgacagaacaagaccctatctca

SEQ ID NO: 461646 - DNA, 515 bp, Homo sapiens
  misc_feature (458)..(458): n is a, c, g, or t
agaagctgctttagtgagtagttaatacataaaagaacggctttaggttatacagatatattttaggaaaatccctatggttgtctgttgggtttaggctcttagtcatctgaacttatggatttttttacaatatctgaagtctgcctgcaccagttccagtacatggggaagcgatacatagccaggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctgggatngggctatcaaaccagacggatgaggaagtgttccatctcctgggattgggctatcaa

SEQ ID NO: 461647 - DNA, 6117 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461648 - DNA, 6186 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461649 - DNA, 6221 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaccttttatcaggtgatgcatttcctcatgtttagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461650 - DNA, 4510 bp, Homo sapiens
  misc_feature (880)..(880): n is a, c, g, or t
ctttacttctctgagcctctgttagctcatctgtaaatggggactttcttctgccccagattatggtgaggattagatggcacaatctatgtgaaattgtgagagcacgtagtacagtgcctggcacacaacagattctcagtctatatgccatgtcattcctgcctatcattgttcttggcaagtgtagagtgaaagcctgtggccatacatcttcatgagccatcagcatccccatagccaccgtctctgcttatctcaggccccaaagactctggctttttccctaagagaaacctctttacctatttctcaacctcagtgtaaaatataagaatgcaaaaaaggttagctattagatgatagaactcaaacgatggtaatactaaactgttaagggttcacacagaggtttaaatgcacataccattgggtacagctgtttcgcttcagagaacttatcctgtaggtatagttagacatgcatgcaaagacccacataaaaggatgttcattgaaacataattataatagcaaaaagttaggggagagaaacagtaactgcctatcagtaggagactagttaactcaattatggtctatccacatagaggaatattacgcaacttgggaaaacttgagatagatccaagctatattgttcagttaaaactcagagagcaaaattatgtgtgtaatatgcaaagattttcaacaaattccctgttggggagagatcctgtagtaggagacaagagagcccggctttaggttatatgtccacttgtattctttgaattttctagtctatttaagagcatgttacgaataagttaaatgagcattatgccagaatatagcactaaatgacgtatgatgnaattaaagttcaaatgcagcatgttgaaggtgaataggcctcaggtgtgtgatacccagtgtagagtggtcagctataaaagagggcaggggaagggtttagaggcctacactccagggtttagaggcctacactccaaggttccttcccattttcacaacaggtgattctccataatgtatatcatatgtattgtgattctaagtaaatgtttattttctagatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461651 - DNA, 2780 bp, Homo sapiens
ccgatgaagatgccgttttcgcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461652 - DNA, 684 bp, Homo sapiens
ctatagaacgagccgttacccggggacacttacgacttctagtctgtccacatctggagcatagtcatgcatagctgggatgctactgtgtgctgaacattatatttaagaaatgtctttgatcccatgtgtaaggaccccatctaattccttgtctccttgtttcctaagtgctgatagcatcatcattgttctactactgctgtgataataatgaaatgtttccatttttacatattctttgctttattcactcctgtggtgtgtagggtcattattcatgtggttgcccagtgccatgaggaaggattggagagccacttgaggtcatatgttaaggtatgtaaaacacactgttctgatcacttacatctgtggctctccagttttccttctaaggacttattttttcacaagcctggttatttgaggatgtgcttgtaacgtatgctttctcttctatttctcatagccaatgcttgtacctgaataggggaggtacgaagagggacagccattcactaatttacttaattccattccttcaattatgtttcttttaatgggttttccaaataatatgactcaatgtggaagtttaaagaagaattttaagttgttcttggctaggcctctgctaacgtaagtgtctccgggtccgagctcgagtcgtatcatgtactt

SEQ ID NO: 461653 - DNA, 700 bp, Homo sapiens
agccggaccggagacacttacgttagcagaggctagccaagacaactacgacttctagtctgtccacatctggagcatagtcatgcatagctgggatgctactgtgtgctgaacattatatttaagaaatgtctttgatcccatgtgtaaggaccccatctaattccttgtctccttgtttcctaagtgctgatagcatcatcattgttctactactgctgtgataataatgaaatgtttccatttttacatattctttgctttattcactcctgtggtgtgtagggtcattattcatgtggttgcccagtgccatgaggaaggattggagagccacttgaggtcatatgttaaggtatgtaaaacacactgttctgatcacttacatctgtggctctccagttttccttctaaggacttattttttcacaagcctggttatttgaggatgtgcttgtaacgtatgctttctcttctatttctcatagccaatgcttgtacctgaataggggaggtacgaagagggacagccattcactaatttacttaattccattccttcaattatgtttcttttaatgggttttccaaataatatgactcaatgtggaagtttaaagaagaattttaagttgttcttggctaggcctctgctaacgtaagtgtctccgggtccgagctcgagtcgtatcatgtactt

SEQ ID NO: 461654 - DNA, 1549 bp, Homo sapiens
gagataagctgaacatctccctctgtaaaccagcagccaggctttccggctgcacatcactcacgtgatggagtgagtgtagacttgtgtgtgtgatgtggggtgcaacacattgagaaatatctgcttgcatccttatactcagtaacattgtgttgcacgtggcaacattgccttaaactctgtaacattttgttacacttggtaacattgtgtcacacatggcaacatggcattgcatatggtaaccttgtgttgccctcagtaacgttgtgtttctgtcctcgagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461655 - DNA, 1180 bp, Homo sapiens
gagctcggtacccaatagcttgagcacaggcgtgcctgtacacgggctctcagctcatcatcctttctctccccttccccttggacctccctgtgctcggtctccacagtgattgtctggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461656 - DNA, 3753 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtcgtgaaatcccagtgaaatccccagtga

SEQ ID NO: 461657 - DNA, 2721 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattggtaacgctccatgctcttgtgggcttctctccaccatcactctgaaagtgtcttggagccaatagttggtgaacgtgtcacacttgtgtggtaggaccttgaagtctaagttgctttcctgagtattcttttcctgcttgtgatagtcaacaactgaaacccctcagccatgccctgaaataaaggtcccggatgcctgtgactcctcaggatcatacagtaatcactggctcacg

SEQ ID NO: 461658 - DNA, 693 bp, Homo sapiens
atcctgtgcatgtaattgatcaagcgtccacattctgacattccagctctgaatggatgttaatccttgcactactgtgaaaacataaagcccatgaatcaatttgtgagggtgtggaaaagcatccaataacaaagtgactttttctgtgttttcagtgtgagaaagatatcaagtgtgcttggaatttctgtagacaatggtaagatttaatcaggttgaagtctgctttatgaggttgcttcacttgcaagccaagaccctttttgttcatcttgccttcctaactttggggctttctaactttacaaaagagattctgccagaacaggggagcatatttttaatttacttttatcagtcagcagaggggacaaggcattgtgtgctgtttctagtaatttaagtgctttatcttcttaagggtttctcaaagcagaacacctgaaagatatcaaccatacagcacgtgaaaaattgatgagatcatttataatacccatttctgctagcattgtgttctctaaattgttccatctcttctccaagcatgacacagctagttattgttttatctcaacaattatttgttattccaagtgctgtctttaatacatggttattaatatccttccatcatgtctaataataaattccattcgctgtgatttttcacacctctttttaaaatac

SEQ ID NO: 461659 - DNA, 168 bp, Homo sapiens
tcttcccccggaattgaagggtacattaccgagcactgacctgtctgtggtttatctgctgcttcctctcatcctgtctagtttccctcaacattctatgaagggagagcggacatgtgtgcggctctgtgttacgagattctcaagtgctgtaactccaagctgagc

SEQ ID NO: 461660 - DNA, 1535 bp, Homo sapiens
cagaaagggatgctgcagtgcagcgcagcacacggcaagagatcctccagcaggacgtggcagggagttgaggttggtttggctgagaagtcccttagtgtctcagcgtcctcttctccaagcctctatcagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgtcaggagtccagaagtccaaaatcaaggtgtcagtggggttggttcctactggaggctcatgggccatgctcctctcacagctgctgatgctgcaggcaacttttggtgctctctggcttgtagtggcatcgcgccagtctctgcctctatcctcacttggtgttcgttctccatggtgtttattagaagtgagactggacatcagggatgccaagactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgataaataacgtcccgaaaataattttatctttgcatttccctaataatttttcatcttgcctgcagagtctgcctgcaccagttccagtacatggggaagcgatacatagccaggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaaggtttgtatcaatttgctgttc

SEQ ID NO: 461661 - DNA, 6247 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461662 - DNA, 5901 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461663 - DNA, 4156 bp, Homo sapiens
gcttaccaatgccatttggaaagttcaacggaatataatgttcatggttgcacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461664 - DNA, 3043 bp, Homo sapiens
tccctttgctctcctgatcagcattttgctttgcaaacagtgttttttaaggatagcagaatcactttctgtaattattcttaaaggggaagaaaatacctcagacattgtttcctacacggagcgacccctgctcaaagcaccccccaacccccactttgctgggtccttaggcacatcctaactgaacgcagaagcccagcctgggcagtcatttgaaggtaaattgatttgctcatgtttgtgtgtccctaaggtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgacca

SEQ ID NO: 461665 - DNA, 3601 bp, Homo sapiens
ataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtgcgtgtggtttagctttccaatacagatttactctgtagaatcctgctgtatcaggaaaactttgagtatcacattaaccaatttaccttgtcataaagatactgcaagatctggaaaactgggaagccacgtttgctggcttggtttatttcatgttccattactataagatatgggcctgagatgcgtttctgttggtaaattgacatttaaatattgaatcaatattggactgactaaaattccattgaatcaagaagtgttagaa

SEQ ID NO: 461666 - DNA, 2341 bp, Homo sapiens
  misc_feature (128)..(128): n is a, c, g, or t
cgagcgctcctgcaccgtggggtggcggagccgggggactgcatggaacccgggacgcccccgcggggagaggagcgcgagcggccgcgggaggagggcgcccaaggcggcgggggaggttaagccgnccgcctgcgggagggacgctcggcggccgcgacggggggcgctggcggcggcggacgctgcagcggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgaggtccaccggcaacatggactcagagttgggaaactgagtcctctcctgggtgaggctcatctggctgaacaactatgaagccatttaagtctgttttccttctactgtgcccaaaaggcacaaggcaacctggcctgaggttggagcatggagatctagaggaactcatggatggattcaggcgggatgtgaaagtgctgggagtgagggcctgggcctcctctgggtttagccacccttccaggttgtgtacaacctgccatatgctggggctcattgactgtgctctgctctgtggctacaggatccccttttactgagcgtagtgcatgtgtatgctctgacaaactcctccgtggtttgcctctgtagtcctccctacaccctaccaactccccagtccccgcgaataaaaacccttgcctttttggaggcaatgtagcaaagcaggactgctgcattggaatagtttggctctggagagttcactagatgtttgaaattcagtttcgtcccttgtaaaaataggggaaatagacccctacctagtacctagtaccatatacatatattatctcaaaatggatcgaaggcctaaatgtaagagtgaaaactagaaaactcttagaagaaaacagctgtaaatctttgtgaccttggattaggtagtggtttcttagattttatgccaaaaataaaagcaacaaaataaaaaaaataaattggacatcttcaaaattaaaaactttggtacttcaaaggacacaaagtaaaaagaaaatccacagaatgagagaaaatgtttgcaaatcgtagatccaataagggacttgtatctagaatatataaagaatgattacagctcaataataagacaaataacccagtagaaaaatgggcaaaagatctcaatattaatttctccaaagaaaatatataaatggcaactaagcacatgaaaaaatgctcaacatcatagccatcaaggaaatacaagtcaaaaaccacaatgagatactactttgcacccactaggatgactatagtgaaaaaaaagagataataacaagtattggtgagcatgtggagaagctgtcgtcatgaattgatcgtgggaatgtaaaatgatgcagccactttggaaaacagtctggcagttcctcaaatggctaaacagagttcccatgcgatccagccatttcactcctacatatatttcctttcccaacagaaaggaaaacatgtccacacaaaaacatacatgagagtttacagtggcattattcataatagctccaaagtggaagcagctcaaatgtccatgaattggtgcatgaataaataaaacatggtctatccatacaatggattattatttagccataaaaaggaatgaagaactgatacatgctgtaatatggatgaaccttggaaacattatgctgggtaaaagaagccagccacaagagaccacagagtgtgtgggtccatttagatgaaatgtccagaataggcaaattcatagagacaggaagtagagccagtactgtggttacctaggggtggggagatgggaggagtggggagtgatggccaagggatatgaggtttcttttgggggtgatgaaagtgttctaaaattgtagtgatagttgcacaactctggatataatacaagttggtgaattgtatactttaatggacaaattgtatggtatgtgtgagtttgatctcaataaagtgcttttaaaaatggagaataataatat

SEQ ID NO: 461667 - DNA, 2117 bp, Homo sapiens
cgagcgctcctgcaccgtggggtggcggagccgggggactgcatggaacccgggacgcccccgcggggagaggagcgcgagcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgaggtccaccggcaacatggactcagagttgggaaactgagtcctctcctgggtgaggctcatctggctgaacaactatgaagccatttaagtctgttttccttctactgtgcccaaaaggcacaaggcaacctggcctgaggttggagcatggagatctagaggaactcatggatggattcaggcgggatgtgaaagtgctgggagtgagggcctgggcctcctctgggtttagccacccttccaggttgtgtacaacctgccatatgctggggctcattgactgtgctctgctctgtggctacaggatccccttttactgagcgtagtgcatgtgtatgctctgacaaactcctccgtggtttgcctctgtagtcctccctacaccctaccaactccccagtccccgcgaataaaaacccttgcctttttggaggcaatgtagcaaagcaggactgctgcattggaatagtttggctctggagagttcactagatgtttgaaattcagtttcgtcccttgtaaaaataggggaaatagacccctacctagtacctagtaccatatacatatattatctcaaaatggatcgaaggcctaaatgtaagagtgaaaactagaaaactcttagaagaaaacagctgtaaatctttgtgaccttggattaggtagtggtttcttagattttatgccaaaaataaaagcaacaaaataaaaaaaataaattggacatcttcaaaattaaaaactttggtacttcaaaggacacaaagtaaaaagaaaatccacagaatgagagaaaatgtttgcaaatcgtagatccaataagggacttgtatctagaatatataaagaatgattacagctcaataataagacaaataacccagtagaaaaatgggcaaaagatctcaatattaatttctccaaagaaaatatataaatggcaactaagcacatgaaaaaatgctcaacatcatagccatcaaggaaatacaagtcaaaaaccacaatgagatactactttgcacccactaggatgactatagtgaaaaaaaagagataataacaagtattggtgagcatgtggagaagctgtcgtcatgaattgatcgtgggaatgtaaaatgatgcagccactttggaaaacagtctggcagttcctcaaatggctaaacagagttcccatgcgatccagccatttcactcctacatatatttcctttcccaacagaaaggaaaacatgtccacacaaaaacatacatgagagtttacagtggcattattcataatagctccaaagtggaagcagctcaaatgtccatgaattggtgcatgaataaataaaacatggtctatccatacaatggattattatttagccataaaaaggaatgaagaactgatacatgctgtaatatggatgaaccttggaaacattatgctgggtaaaagaagccagccacaagagaccacagagtgtgtgggtccatttagatgaaatgtccagaataggcaaattcatagagacaggaagtagagccagtactgtggttacctaggggtggggagatgggaggagtggggagtgatggccaagggatatgaggtttcttttgggggtgatgaaagtgttctaaaattgtagtgatagttgcacaactctggatataatacaagttggtgaattgtatactttaatggacaaattgtatggtatgtgtgagtttgatctcaataaagtgcttttaaaaatggagaataataatat

SEQ ID NO: 461668 - DNA, 1910 bp, Homo sapiens
atcataacaaactataaatgagaaggcttttcaagcctctgttttcccctaagctgccttctgtgaccccttatcttgtttcctgtggtgttaatgtcatcgttgtattcccatcaaccaacaatcttttagcagccttaagaagggctgtcaagtcttctgtcaatcctaccatcttactttgatgtttccaggtccaccggcaacatggactcagagttgggaaactgagtcctctcctgggtgaggctcatctggctgaacaactatgaagccatttaagtctgttttccttctactgtgccctcatggatggattcaggcgggatgtgaaagtgctgggagtgagggcctgggcctcctctgggtttagccacccttccaggttgtgtacaacctgccatatgctggggctcattgactgtgctctgctctgtggctacaggatccccttttactgagcgtagtgcatgtgtatgctctgacaaactcctccgtggtttgcctctgtagtcctccctacaccctaccaactccccagtccccgcgaataaaaacccttgcctttttggaggcaatgtagcaaagcaggactgctgcattggaatagtttggctctggagagttcactagatgtttgaaattcagtttcgtcccttgtaaaaataggggaaatagacccctacctagtacctagtaccatatacatatattatctcaaaatggatcgaaggcctaaatgtaagagtgaaaactagaaaactcttagaagaaaacagctgtaaatctttgtgaccttggattaggtagtggtttcttagattttatgccaaaaataaaagcaacaaaataaaaaaaataaattggacatcttcaaaattaaaaactttggtacttcaaaggacacaaagtaaaaagaaaatccacagaatgagagaaaatgtttgcaaatcgtagatccaataagggacttgtatctagaatatataaagaatgattacagctcaataataagacaaataacccagtagaaaaatgggcaaaagatctcaatattaatttctccaaagaaaatatataaatggcaactaagcacatgaaaaaatgctcaacatcatagccatcaaggaaatacaagtcaaaaaccacaatgagatactactttgcacccactaggatgactatagtgaaaaaaaagagataataacaagtattggtgagcatgtggagaagctgtcgtcatgaattgatcgtgggaatgtaaaatgatgcagccactttggaaaacagtctggcagttcctcaaatggctaaacagagttcccatgcgatccagccatttcactcctacatatatttcctttcccaacagaaaggaaaacatgtccacacaaaaacatacatgagagtttacagtggcattattcataatagctccaaagtggaagcagctcaaatgtccatgaattggtgcatgaataaataaaacatggtctatccatacaatggattattatttagccataaaaaggaatgaagaactgatacatgctgtaatatggatgaaccttggaaacattatgctgggtaaaagaagccagccacaagagaccacagagtgtgtgggtccatttagatgaaatgtccagaataggcaaattcatagagacaggaagtagagccagtactgtggttacctaggggtggggagatgggaggagtggggagtgatggccaagggatatgaggtttcttttgggggtgatgaaagtgttctaaaattgtagtgatagttgcacaactctggatataatacaagttggtgaattgtatactttaatggacaaattgtatggtatgtgtgagtttgatctcaataaagtgcttttaaaaatggagaataataatat

SEQ ID NO: 461669 - DNA, 2579 bp, Homo sapiens
agcgcctacattaggcagaggacaaagcgatgttataggcaaggccttggaagcatttctctggtctccagggaagagcaggagttccctgggggttggttccaggttcttctatggctgggatggctgtgcagggatcacggctgccagtgttcagtggcttctcttgaacccagctaccgctccttgtcttcttatgaagcagtgcagggatggagtagagggcacaggagatgctggctgtctgccttggggcagaaatggaaacctagttcttgatggcaccttgttgccagtgtctgtgcagctgtgttctggcctgcagggtggaggagaccttagaggaaaccgaggccgagggcaggtgctgggccccatttctgcaccttctacccagccctgacctggcaccctttgtttctgttctgcagtcaactgccaggatgcaagatggtcctgcccccttggggtttagagctggaaagtgggagagcggagaatcctctggggagaatcctcttcatggctgcaggaaagagagactagtccagaagggaccttgaggggtcatctggcactagtgcccctccaggaaggaaggccctggtggccacactgacttcactcttactatgtgcaggcactgttccaggtactttccaagtattaactaatttaatcctcttgacagccatacagggcaaataacattgttattctttacagctgaggaaagagaggcacagagaggttagggaacttgcccaagggcacacagctagtaagaagggacagagctaggattcacactcaggtgatctggctccaaaaccgccactcttaacccccccttcctcttggcctgcagagctggggacagccatctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcctcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttccttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttactta

SEQ ID NO: 461670 - DNA, 1840 bp, Homo sapiens
  misc_feature (128)..(128): n is a, c, g, or t
cgagcgctcctgcaccgtggggtggcggagccgggggactgcatggaacccgggacgcccccgcggggagaggagcgcgagcggccgcgggaggagggcgcccaaggcggcgggggaggttaagccgnccgcctgcgggagggacgctcggcggccgcgacggggggcgctggcggcggcggacgctgcagcggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcctcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttccttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttactta

SEQ ID NO: 461671 - DNA, 1165 bp, Homo sapiens
ggtgctcgggctcgaacttcagtatcgctggatcatgctatcaccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcctcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttccttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttactta

SEQ ID NO: 461672 - DNA, 3438 bp, Homo sapiens
agcgcctacattaggcagaggacaaagcgatgttataggcaaggccttggaagcatttctctggtctccagggaagagcaggagttccctgggggttggttccaggttcttctatggctgggatggctgtgcagggatcacggctgccagtgttcagtggcttctcttgaacccagctaccgctccttgtcttcttatgaagcagtgcagggatggagtagagggcacaggagatgctggctgtctgccttggggcagaaatggaaacctagttcttgatggcaccttgttgccagtgtctgtgcagctgtgttctggcctgcagggtggaggagaccttagaggaaaccgaggccgagggcaggtgctgggccccatttctgcaccttctacccagccctgacctggcaccctttgtttctgttctgcagtcaactgccaggatgcaagatggtcctgcccccttggggtttagagctggaaagtgggagagcggagaatcctctggggagaatcctcttcatggctgcaggaaagagagactagtccagaagggaccttgaggggtcatctggcactagtgcccctccaggaaggaaggccctggtggccacactgacttcactcttactatgtgcaggcactgttccaggtactttccaagtattaactaatttaatcctcttgacagccatacagggcaaataacattgttattctttacagctgaggaaagagaggcacagagaggttagggaacttgcccaagggcacacagctagtaagaagggacagagctaggattcacactcaggtgatctggctccaaaaccgccactcttaacccccccttcctcttggcctgcagagctggggacagccatctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcctcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttccttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctca

SEQ ID NO: 461673 - DNA, 1145 bp, Homo sapiens
agcgcctacattaggcagaggacaaagcgatgttataggcaaggccttggaagcatttctctggtctccagggaagagcaggagttccctgggggttggttccaggttcttctatggctgggatggctgtgcagggatcacggctgccagtgttcagtggcttctcttgaacccagctaccgctccttgtcttcttatgaagcagtgcagggatggagtagagggcacaggagatgctggctgtctgccttggggcagaaatggaaacctagttcttgatggcaccttgttgccagtgtctgtgcagctgtgttctggcctgcagggtggaggagaccttagaggaaaccgaggccgagggcaggtgctgggccccatttctgcaccttctacccagccctgacctggcaccctttgtttctgttctgcagtcaactgccaggatgcaagatggtcctgcccccttggggtttagagctggaaagtgggagagcggagaatcctctggggagaatcctcttcatggctgcaggaaagagagactagtccagaagggaccttgaggggtcatctggcactagtgcccctccaggaaggaaggccctggtggccacactgacttcactcttactatgtgcaggcactgttccaggtactttccaagtattaactaatttaatcctcttgacagccatacagggcaaataacattgttattctttacagctgaggaaagagaggcacagagaggttagggaacttgcccaagggcacacagctagtaagaagggacagagctaggattcacactcaggtgatctggctccaaaaccgccactcttaacccccccttcctcttggcctgcagagctggggacagccatctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggtactatgcgccatgacacctggcctggcacctttctgaccttctctgtggactcctg

SEQ ID NO: 461674 - DNA, 1616 bp, Homo sapiens
cgagcgctcctgcaccgtggggtggcggagccgggggactgcatggaacccgggacgcccccgcggggagaggagcgcgagcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcctcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttccttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttactta

SEQ ID NO: 461675 - DNA, 930 bp, Homo sapiens
gcgcgaccggtactgctactagtgcagttgataatagtggacgttccatcataggaagggcagaggttgtcctcactggaatagacacttactccggatatgggttgcctatcttgcacgcagtggtccgccaagattaccatctgtggactcacagaatgccttttctaccatcacggtatcccacacagcattgcctctgaccaagacactcactttacagctaaagaagtgcggcaatggattcatgctcatggaattcactggtcttaccatgttccccatcatcctgaagcagctggattgatagaacggtggaatggccttttgaagtcacaattataatgccaactaggtgacaatactttgcagggctgaggcaaagttctccagaaggccatgtatgctctgaatcagtgtccaatatatggtactgattctcccatggccaggattcacgggtccaggaatcaaagaggggaagtagcactactcaccatcacccctagtgatccactagcaaaatttttgcttcctgttcccgcaacattatgttctgctggcctagaggtcttagttccagagggaggaacgctgccaccagtgtacacaacaacaattccattaaagtggaagttaatattgccacctggacactttggactcctcctacctttatgtcaacaggctaagaaggaagttactgtgttagctggggtgattgacccgggctatcaagataaaatcagtctactactccacaatggaggcagtaacctggggacagttcattgcagaagcaacaacaatatggggaccagatggccctggagcctgaccagttcttcagtgctccgttagttcttacctgatttcctagcctggacatcctaccacctatggatttgaacccaagggccttcatgaccc

SEQ ID NO: 461676 - DNA, 3470 bp, Homo sapiens
  misc_feature (4)..(4): n is a, c, g, or t
  misc_feature (7)..(8): n is a, c, g, or t
  misc_feature (10)..(10): n is a, c, g, or t
  misc_feature (17)..(19): n is a, c, g, or t
ttgngtnntntctcatnnnggtacaacgaatattattggaattggacatgcaaaacattcaagataaccttgctaaacatttaagtgaaggacagaaaagaaagctgacttttgggattaccattttaggagatcctcaaattttgcttttagatgaaccaactactggattggatcccttttccagagatcaagtgtggagcctcctgagagagcgtagagcagatcatgtgatccttttcagtacccagtccatggatgaggctgacatcctggctgatagaaaagtgatcatgtccaatgggagactgaagtgtgcaggttcttctatgtttttgaaaagaaggtggggtcttggatatcacctaagtttacataggaatgaaatatgtaacccagaacaaataacatccttcattactcatcacatccccgatgctaaattaaaaacagaaaacaaagaaaagcttgtatatactttgccactggaaaggacaaatacatttccagatcttttcagtgatctggataagtgttctgaccagggagtgacaggttatgacatttccatgtcaactctaaatgaagtctttatgaaactggaaggacagtcaactatcgaacaagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctattattggtatttggaatcgcaatattccctttgattgttgaaaatataatgtatgctatgttaaatgaaaagatcgattgggaatttaaaaacgaattgtattttctctctcctggacaacttccccaggaaccccgtaccagcctgttgatcatcaataacacaggtttgcccagctgtgctcctcagataaggtctctcagtatacgtcacgaccctgactatagcttcagagcataccttacccccttgcattcatccactctgagttcagaatcaaatattgaagattttataaaatcactgaagcatcaaaatatacttttggaagtagatgactttgaaaacagaaatggtactgatggcctctcatacaatggagctatcatagtttctggtaaacaaaagacaaagcagttaaatctatcaacgttcaccatcctgagccagaaactctccaagatgtttagaatttccccccaaagtagagatgctaagccaaatccagaagaacccatagatgaagatgaagatattcaaacagaaagaataagaacagccactgctctgaccacttcaatcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcatagaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaactcatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaacttagaattttttaaaaatatgacttttttaccttttacaaaacattctcttgctgaaatatgtgaagggtatattcagtagccaagagttgcatgactacttcacaccagttcatgatacaacaggtatacaggttttcttttataaccaactacaactcaagagtcttctgaaagtgttccagaaattgctttaaaactcaaaagtaaggggccaggtgcagtggctcacgcctgtaatcccagcactttgggaggccgaggcaggtggatcacaaggtcaggagttcgagactagcctggccaatatggtgaaactccatctctaataaaaatacaaaaattagccgggcgttggcatttgcctgtagtcctagctattcgggaggctgagggaggagaattgcttgaacccgggaggcagaggttgcagtgagccatgtgctagtgcactccagcctgggtgacagagtgagactctgtcaaaaaaaaaaaaaacaacaaaaacaaaaccaaaaaacctcacaagtattaggaggtccttggacacacaagtagacaagcactcatgttgaaaagtagttccattataccttttgaaaataaagggagtcacagtagtatttgttcagattttttaaattttgcatactcttaacaacattaacttattgttttcagggggtgctaattttccttgtcatctttgaatagttttatgggatttgatattttttaaaatcatttctcccttatataagtgtatgt

SEQ ID NO: 461677 - DNA, 5750 bp, Homo sapiens
ccttgatttgtcactgatcaccaaccttcaaatcctctctcagtttcttcttttttttgtttttgagatggatctcgaaaaaacttcctactgtacacctaccctatataaacctcaagctcccagaagctaatcatgatatgcttactgacatctaaactgcaaagtagttgaaatattaacctcatgtaaacccacttaagtaaataaagctacatacaagcaattctgtgtgcagggtggcccgaggcactttaagggttgtggcttggggattattaagaacctcctagaaataattctttcctaaatggtcagttgatggtgagcgctgaaaagccgatgggtactgctcggccaagggattgaaaaatcggcctttgagaagaacaaagtcaaaatgaaagattagattataatttctctggggtggtgccagttggatctaggaaacttaaactcgtgaaagaatgtgcttagagcagaagatagaagctggtggctgtctctgctcccctctacctctctcccgggtcctgggtctccctagaggggcgtccgacccgcggcagccccactcccagctcgaatccctcccttcaggtcgctccagggcgggcagccaaggtgggcctccccaggcgctgtgatccacatttcacctcctaacaaccggcctctcggccggggttgaggactcagcgaggccttgactccgtgggtctgggcaacagccggctccgccccgccccgccagccgggtccctccccatcccgcgacccaacggtcgttccccgccgccggccccgcccctccctggccgcccgcggcgcgccggcgcctgcgcagtcgccccagagcgccccgaccgggatggcggccgttttggagtcgctgctgcgagaagaggtgtcggtcgcagccgtcgtgcggtggatcgcgcgcagcacccagggttcggaggtaacagcggtgacacgcccccaggtctgactcgaagccggttcccgcagtggagtccagccctccagtccccttcctctagggcgcctggctgccagccgggccgagtgcactccaactgggcgccgctgcccgggccgcccacccgaggcgcgccctacggccccggctgctcacggcccgcgggccggcggctgaccctctcgcccctccacctgtgcttctgccctaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacaggcaggacgaagccttctcgcaggatcaacccaactccggtgagcgaagagcggtcactctccaagcccaagacctgcttcacctcacccccaatcagctgtgtccccagttcccaaccctcagccctggacactagcccttggggccttggccttcccccagggtgcagaagtctgcaagaggagcgagagatgctcaggaaggagcgctctaagcagctgcagcagtcacctacccccacctgtcccaccccagaattggggtcgcccctccccagccggacaggaagcctcacagatgaacctgcagaccctgccagagtgtcttcccgccagcgcctggagcttgtagcccttgtttactcctcgtgcattgctgagaacctggtaccaaacctcttcttggagcttttcttcgtctttcagctcctcactgcccggaggatggtgactgccaaggacagcgaccctgaactaagtccagctgtcctaggtcaggttctttccaacctggacaaagggaccttgaagctgctggctgagaatgagcggctgctgtgcttctcaccagctctgcaaggccgccttcgagctgcctatgagggcagtgttgccaagccagagactgacaatcgtgccaacttctccagtgaccgagcctttcatacttttaagaaacagagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcattgtcacctgtcttctccctttagaaggctgcagtctcgggtgggctgtaggtggagcgctgtaattgtggctttgctctgtgcattacaagttcttacttgggctatagttgagcaacttacctggttgctgtttaccctgcaaagcaatgccaagttcatgggaaactgtacatacatgtaaactgaatctttgaaacagctatgagtgggtatt

SEQ ID NO: 461678 - DNA, 1713 bp, Homo sapiens
ccttgatttgtcactgatcaccaaccttcaaatcctctctcagtttcttcttttttttgtttttgagatggatctcgaaaaaacttcctactgtacacctaccctatataaacctcaagctcccagaagctaatcatgatatgcttactgacatctaaactgcaaagtagttgaaatattaacctcatgtaaacccacttaagtaaataaagctacatacaagcaattctgtgtgcagggtggcccgaggcactttaagggttgtggcttggggattattaagaacctcctagaaataattctttcctaaatggtcagttgatggtgagcgctgaaaagccgatgggtactgctcggccaagggattgaaaaatcggcctttgagaagaacaaagtcaaaatgaaagattagattataatttctctggggtggtgccagttggatctaggaaacttaaactcgtgaaagaatgtgcttagagcagaagatagaagctggtggctgtctctgctcccctctacctctctcccgggtcctgggtctccctagaggggcgtccgacccgcggcagccccactcccagctcgaatccctcccttcaggtcgctccagggcgggcagccaaggtgggcctccccaggcgctgtgatccacatttcacctcctaacaaccggcctctcggccggggttgaggactcagcgaggccttgactccgtgggtctgggcaacagccggctccgccccgccccgccagccgggtccctccccatcccgcgacccaacggtcgttccccgccgccggccccgcccctccctggccgcccgcggcgcgccggcgcctgcgcagtcgccccagagcgccccgaccgggatggcggccgttttggagtcgctgctgcgagaagaggtgtcggtcgcagccgtcgtgcggtggatcgcgcgcagcacccagggttcggaggtaacagcggtgacacgcccccaggtctgactcgaagccggttcccgcagtggagtccagccctccagtccccttcctctagggcgcctggctgccagccgggccgagtgcactccaactgggcgccgctgcccgggccgcccacccgaggcgcgccctacggccccggctgctcacggcccgcgggccggcggctgaccctctcgcccctccacctgtgcttctgccctaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacagggtgagactcagctctcatgcaggagatgggtaccacga

SEQ ID NO: 461679 - DNA, 392 bp, Homo sapiens
gtcacctacccccacctgtcccaccccagaattggggtcgcccctccccagccggacaggaagcctcacagatgaacctgcagaccctgccagagtgtcttcccgccagcgcctggagcttgtagcccttgtttactcctcgtgcattgctggtgagtgagagcggagggagcgggagtggagacacttgtagaacttatgggtaagagaattggtaaggcacttggaactgagccttggctccaaatggtgcccataccatgggctttctttttgtatctatctagagaacctggtaccaaacctcttcttggagcttttcttcgtctttcagctcctcactgcccggaggatggtgactgccaaggacagcgaccctgaactaagtccag

SEQ ID NO: 461680 - DNA, 2186 bp, Homo sapiens
agaggaaagtgactatacctatctgcagggactgcagctggctgcccagaggaggtggcatctgaattgggtccccaaggatccgtaaatattggccaggtgataaggcagaagcaagaacaagctaatcaggaggaatacgcaggggaaatcccagagctggtaacaagcagctcttgtgtgcaggagctgagagagacccaaggcagggtctctctcaaggctgaaatcagtgtgtcaaccagggctgggagctcatctgaaggctcaacaggggatgtatccactgcaggcctcttctcaggatattgttgacacaatttagctccttgagggtgctggactgagggcctcacttcctagatgactgttggccagtggccaccagcaattctttgccacatgagcctctccagtattgcagcttgcttcatcaaagtgtgcagacaagaagacaaaaaagagagctgcaagaaagacggaaaccaagatctcatgtaacctaatgacagaggacgaagtcttgctctgttgaccaagctggatggagtgcagtggtgcgatcacaactcactgcaaccttgacctcctgggcccaagcaatcctcctgcttcagcctaccaaagtgttgggattacaggaatgagctaccatgcccagccaaaagcccagggttttgttggatggtagtacaaggagatgctttctcactgcacccccacctcccatctttgaggataaacaaggaagcacgtcttcccaagaggcaggggctatcttgaaaccatgaagaaagactcatcctgagaagaacgcaaacaccaaacaagtggaacctggagatactgagagaaacagggtcctggttgtgtcccctgagctgctgaacttttcagatgcacaaacccattacatttttttattaaaaatggtttgagtccggttttctcttacttgctcctaaagtatcaaaataaagactagagaggctctgctatgagcagagtggggggaatatgggaaagaagatgagaggcaggaaacagtatgagattgtagctaaggagtgcattttaacaaatatgaatgctctttccaagccgttattgttcctagctctaagttcagaaggaatgtctccatttcctccgcaacaaccacaacacactacaagtcaatgtctagtccgtgaaagtgtgaaatccacagcgtccttaggcaaggacctaactccacaagaagactccatttatttaggcagtattaataaggatccacaagatgcccatggaagggatgctgctgggatgaaggaacgaagatcactggtctcaaacagcccacagtatggtgtggatgcaaacgtgaaaattatcacacaagacagaaataaagaaatgctgagagatgaacagacaaagaagcctataagaggaaaccctaaaacactttcaaaattctgtccttcctgccaaactcagggatacatgaactttccctccaccacagtggagtgtgcagtgcagaaaagtctgcacattggggaagacaaactaatttgtgcttttatcattgagtgcatctgtgtagtattaaatcacgaaatatgagccgcaaatagggaagactctcttcctgaattgtgacctttgagcaattacagatggagagaaacactctccatagtgtcataagaagatcctgatgtcaatgaattttgacatatgtatgtatatatatatgtgtgtgtgtgtatgtgtgtgtgtgtgtatatatatatatatacatatatatacacatatactcagaaatggaattgctgtagttttaaccattataaaatatccctaaattcattaatatttgttttttaagtagcactgttaaatgtacattaaagaaaatttagatgacaatgtcacccatttatgccaccttctcctctagtttcttaattcaagtttaagcccagggcttacataagtcagtgtctgaagtttcactcaccttaggccattggcattgatgcagagcagtgtggagacatgctgttttccataatttctgttcatgaccttcattctttaatgccttaattcaaggcatattgaagaacattggcactctgtctgagtttcctatttggttaaactcaacattgtgtttttttcttaattgagtttct

SEQ ID NO: 461681 - DNA, 1009 bp, Homo sapiens
gttggaatgggataggtagttccccgtttccaggaccccagacggcctgctgggacagtgtatatgagtccggaatgggctggaccagggtcaggctagcccagacttcaggtacgggctgtgatgacgaggagtgggctagtctcccgggtcggtcaccgctgaactctcagagacaatcaagctttcgatgatcatgtgatgaggtttccagtcagttccaggtgaagacaccactggccatcaagaagctaccctctccccaccagacagagcaggatgagagttctataatcctcaataggaggaagcactcaattgaacaagtgcaggaaccagctggctgcctcagcactgacagaagcaaattccatttgcttggacccactgcattccatcccttgtggaagagagcatgtaagcaagtgagtgcaggaactggctggctgctttggtgctggcaggagcaaacaccatgaaggccccatggcagagtccaggacaggaccttcaggcctctgaaaaaaaaaggatcaaagaactgaaactcaccagatcacctcaccagatgctggacccctcattcaccatttttccttctaacagtcaggcccctctgctgcaggtctgctggagtttgctggaggtccactctagaccctgtttccctgggtatcaccagcggaggctgcagaacagcaaagattgctgcccgttccttcctctggaagctttgtcccagaggggcacctgccagattccagctggagctctcctgtatgaagtatctgacaacccctgctgggaggtgtctcccagtgctctgtccaagggagatgggagttttatctataagcccctgactggagctgctgcctttctttcagagatgtcctgcccagagaggaggaatctagagaggcagtctggctacagtggctttgctgagctgcagttgactctgcccagttcgagcttccaggcagctttgtttacgctgtgaggggaa

SEQ ID NO: 461682 - DNA, 3979 bp, Homo sapiens
  misc_feature (1)..(1): n is a, c, g, or t
  misc_feature (8)..(8): n is a, c, g, or t
  misc_feature (11)..(11): n is a, c, g, or t
ngcccatntcncagaacccttcacgcagtaggtgtcagcatgttcgctgagtatatgaatgattgcaatatattgatttttataagtctgtgtgttggcattaagaggtggggactctggaaggtgagtaggtcctgggggtacagccctgcagagaacatcgagattgtagccaagcaaacatttgataaagagatgagtatggtagagggaagccagatgctgctaatcaagacaactgaggaaggacctccggaggcaatctttggggctgccccacccatcttaggcccagaatgccaggaccctggggccagaacaatttcaagtctctgctccctgcaatcggatgcagtgctcctcggctgccccagctgtggctccagtgggtccaggtgtagctcagatggtctctctggaggacacaagcaggaagccttcgtgacctccacgtggtgccaactctgcaggcacacagagtgcaagagctgtgagaatgtggccacctccacccagcttccaagggatgccctggagaacttctgtgaccaggcacagacctgacacaggagcagggccaacaacagaggccccacaagggcagtgttgtgggagaggggctcctcactccgtaagaatagaaatgtctgtcttatgcctgtcccaccattgtattttggaagcacacaatttatttgatttcataggctcatactgggagagaaatgtgcctcaggatcaatcatacctggactctcacttgatttagatgatatttagatgagactgtggactttagactttttaggttgattttggaaagagttaagacttttgggggctattagaatggaatgaatgtattttgcatgtgagaaggatataaattttgggaggttaggggtgaaatgttacggactgaatgtgtccctccaaaattcataagctgaaatctaatccccaatctgctggtattgagaggtggtgcctttgggaagtgattaggtcattagagtgatgtcctcatgagtgggattagtgcccttataaaggagggagcatctgtcctttctgctgcgtgaggacacagcagcagggcaccatctatgaatcctggatctcatcagacaccaaatctactagtactttgatcttggacttaccagcctctagaacagtgagaaataaatttctgtcatttataaattatccagcctaaggtatttttgttataatagcccaagtggactaagacagtaactgattcacagaaatttggttttcaagacgttttagaccaagagaacccctaaacatataggtggatgtaagctggttaacttatcttgcgctgactgtgctgagcattatcagtttctaatgatatcaagctacttagaaagcaatgaagctgaaagttcttctaaaacaaaatgagaactttgaagaagctttttaaaagtaagttttgtttgttttagttcccctgggtaggcaaacatataaacagagctccattgtctcttcaaaacccacttaattaggttttctcaagtttatatggaaaacacctttgtggagtttgacacatgccatacttcatattgttttaactactcttcttcattttgaaagatacagatggtactaaaatgagttggattgattctcttgagcaaaggcaatgctaacaatacaaggaaccaatcctcatctacaaaacaggttttagttttgacaaggtttgtacctatgagcttgttctctggtcctcctccccacctcccaattaacagaaggtaaccaatactatgcaataaacaaatgggaatgaatttatgataaagggcaaagctgaacaactgtttggatgggacagtcagctataaaactgaaaactgctgaagccaactcactggttaggaaaaaagttggaaatgcgtgggtgtgttctcaaggtcttaggaaaattccggaagtccagcagatgttttctgttaggaggcaatggaagccccaagagctacatcttcttcttcattctcttaattataagtttacttatgaaatcattttttttcttaagtatctctctgccaatacttacaaaatagaaggctggccaaagtagtcaactcatgagccttcctgtgtaaccagaatatgtgtacgtgggcaggaaatctctataggaagcagaaatctaggtccatcattataaatgctttatcttctgaataactcttttagttactgaagtggaattacaacttttttaatcttatcaattataaaagtatattcaggtttcattgattacaatatttttcccccttttggaaaatgatgtaattaatagtcatcatagtaatttttctgtttttttggttctctatataaacattaataaatggggatagattcaaggaatcagaagttaatgaagcatattttaaacatttagactttctgctgtcttaattttgaatacgtgtttgaatacctatgggaggctacttttcttactgcatttgctttactagcttctgtgttatgaaatctaaccatcaactctttcagggagaaggaatgaacatttccgtctgaccaaagtttcaaaagtcaagaggtgaattaatgttcagaaaatacttaaaatcttatttaaatttctcatctgcttaagaactttttcacttttttttctgtagtaggtatctgaagaccaactttttcacttttatcacatatgcaaattgatctccaaaaggtttattagagattgggtctatatatcaaaaggtactttatgaatgaattaagaagggagtttcctatctaggctggctagttagtgaggttgcagaagcagtcagcataaaaactttgttaaagttcaggaatccagctggctgtatgttttggagaatttgtctgattactacacatggttactagatctatcgtgaatatggaacaaattcaagaacattagattctcttggccttgtggagattactcaattcatctagaattttaatcgagcatcttacagatggaacttctgcaattatcaagcttcagaagccatgaccaaagcaaacctcactcaaatcttctcttaccctcaaaacagaatgttttcccctaaaagaagcaggtggcctatcatattcctgccaggaagatcctgcagggcaggcataatcagattaaaatcaattagatgaactgtgtgggaatttgcattttaaacattctcatggcacatccccccaaatttagacaatttttgaaaagttccaatattttcatatatttcacaaaactggattgtgtcaccaagggaatgctatgcatctggagaataaaaggtttcacaggacctaggctcagttccacacatttatttttgtcctctgtgggaaagaaaataggtaaagtggttcagagatgcaagactttaggtctggggccaaccaaactcaaagagctgctttaaagcccattatgggtaaagctagacttcttcattctcagaccaagtcaatacgggagctcacttatgccccacatgccagcatgaatatgtcactaatatatgatggccatcaaggttctctggttgttttgtgaatgttatctctcaacaaggtgtctgacatcacaggctctgagggcttacgggaggaacaagattttatctttgctctccttggtgatctagacaagtggtttaaccttgggctcctgtgcggatgtgtgagttaagtagctagtgagggaaaaatgtgataggtgttcaataaattttcttcacctttctccccaatgccctttcattcctttgacctgcttcttaaacatccttcacaatagttaccagaatactgggcacagagtggcctggctgcttaacaacttacacattctcccagttttcctgccaataaaaaaagcttcttacaactaaaaacc

SEQ ID NO: 461683 - DNA, 1931 bp, Homo sapiens
  misc_feature (3)..(6): n is a, c, g, or t
  misc_feature (9)..(10): n is a, c, g, or t
  misc_feature (13)..(14): n is a, c, g, or t
tgnnnntcnngcnnttcagagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcggtgcgtgaggttcccggcgcggggtggccaggactgcctcgccctggaaggtccggggcgggttcgggaggcgggaaggcgctcccgggaggagagcggaagggggcggtgctcactgccagtctaagcaggaaggcggggatccagtcgcggcttcgctgtgtgctggccgacggcgcttcccggcgtgccccgcgctgcggccggaaggggcgggccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccggcaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcaggtgcgggcggcggggaccggggctgctggagcagcgcgcgcgtctcttctgcccgactccgcgagagcgcagaagtggtcgcgctctacagtgagctcgataacctaattaccagagttgggaaccaggttgaacgcttggtaatggaccgagatgagggacgttttccagttagaagaggagctgctgtctacatttgccatctgctgttgcctcttgtcaatgggaacagccaggaccgggggcagggggctgtaacttcctttgcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaa

SEQ ID NO: 461684 - DNA, 2334 bp, Homo sapiens
aggagctgcagaccagggctgggactgaccccaggaatgtctcccccggctgcaggccacactcaacctccagcaattcatcaaaattaccatttatgcattccgtcctaccaatttctggctctagtgatttctgctccagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatctttatccctcaacttttggaacatctattctacgagtcatatcagaaaagttacccgtgggaactgtctccaaatacatacttcctctcaccaggacaacaaccacaggatcctctgacccatttactggtcatcaataagacaggtgaacatggggctgaaatgcagctgttaaatgttgttcttgttgagagattccccccaaaaaacatgaacagccaagaaaaaaataaactctggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaagtaagaagagttaaagtcttcacatgttttttatatctagagaacccttcccacacccttacgactataaatttacatgcaagtggtaaatctaatttttgtacttgatgcaatgaataatcaagcactttaataataattgtcaaatatgaagaaaatgctatctttctgaaacaaataaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaagtaatgtagccagtttctgaacttaataaaaatggaatcatgtagaaggcataattatatatctgtatataatc

SEQ ID NO: 461685 - DNA, 7019 bp, Homo sapiens
gaatacaaaccaccttctccaagcagggcatcaaaaaggcatcagagggttctggcaactagggtcagaaatattaccaaaaagtcctctcacttgcctcttggcagtcctttgaagagacaacaaaatacaagggacccagacaccatggtcccactcacagatttcagcccagtaatggatcattcaagagaaaaagacaatgatttatctgacacagatagcaactactcattggattctctctcatgtgtctatgccaaagccctgatagagccactgaagccagaggagaggaaatgggatttcccagagccagagaactctgaaagtgatgacagccaactatctgaggactcactggctgagaagaggtaccaaagccccaaaaacaggctagggggcaatcgtcccaccaacaaccgtggccaacccaggaccagaactagagcttctgtgaggggcttcactgcagcctcagacagtgacctacttgctcaaactcataggagcttctccttggatagcctgattgatgcagaggaagaactgggggaagatcagcaagaagaacctttccctggttcagctgacgagatacccacagagactttttggcacctggaggactctagtctgcctgtaatggaccaagaggcaatatgcaggcttggtcccatcaactacagaacagcagctaggctggatgccgtcctgccaatgagcagttcgttttaccttgatcctcagttccaaccccattgtgagctccaaccccattgtgagctccaaccccattgtgagctccagccccattgtgagcaggctgaatcacaggtagagccaagctactctgaacaagccgactctctccaaggcatgcagctttcaagagagagcccactgatgtccatggattcctggttttcctgtgactctaagatcaaccccagcagccccccaggaatagtgggttctttatgtccaagtcctgatatgcaggaatttcactcctgtaagggggagaggcctggatactggccaaatactgaggaactaaagccatcagatgcagaaacggttctgccatatagctccaaactgcaccaaggcagtactgagctcctctgcagtgcaagagatgagcacacagcctctgctgctgatacgtctaggctgtctctctggggaattcaaaggcttattcaaccaggagctgatggcacctttcagggcagatgtatccctgacatgacccagcagggcagctctgaagcatcccacaattctagcgtatcaaacgtgctggctgcctctgccaccaccttgactcatgtaggcagcacccatgaaagggattggtctgcccttcagcagaagtacctccttgaactctcttgtcctgttttggaggccataggagcacccaagccagcttacccctaccttgaggaagactctggttccctggcccaagcttctagcaaaggaggagatactctattgccagttggccctagggtatctagcaatctgaatctcaacaactttccagtccatctgtccagaatcaggcgtttgagggcagagaaagaacaggacagtttaaatgccaaattagaaggtgtttcagatttctttagcactagtgagaaagaggcgagttatgacgaaacttattcggcagacttagaatcattgtctgcttctcgatctacaaatgcacaggtctttgcaacagagaacgcgataccagattccatgacagaagcatgtgaagtcaagcagaacaacttggaagaatgccttcagagttgcaggaaacctggactgatgacttcctctgatgaggattttttccagaagaacgcttgtcacagtaatgtcactacagccaccaaagcagaccattggtcccaaggctgggctcctctcaggaaaaatagtgcagtccagccagggcaattaagtcccgacagccactacccactagaggaagagaagacagattgccaggagagctctaaggaagcagttagaagacacataaatgtttcctttgcccttccttcaggtccagagctataccttcactctgctccctggaatccattgtcatcttccctgcagcccccactcttggaaacattctatgtgaccaaaagcagggatgccctgacagaaactgccttagagattccagcttgcagagaagtaagggtaccctccccaccccccagggaagcctggggctttggtcacaaccaccaagctctccaaggtgcttatttgaagaataatttgccagtgctgttacaaaaccagaattctaagattgcctcatctcagcaggtcacagctgagataccagttgatctgaataccagggaagtcatcagagaatcaggtaaatgccctggaaatattacagaagaaagccatgattcagtttattcttctgttactcagaacagacattttctcccctctaccagcacaaaagtatgtgaatttgaaaaccaagttgtaattttaaataaaaaacacagttttccagcacttgagggaggagaggtcactgctcagtcctgttgcggtgcttcctcagacagcactgagtctgggaagtctctcctctttcgtgaatctgaggcacgagaggaagaagagctggatcagaatacggttctgaggcagaccatcaatgtaagccttgagaaagacatgccaggggaaagtgctgtttctttgaaatccagatcagtagatcgtagagtaagcagcccagtgatggtggcccagggtggtggcccaacccctaagtgggaagggaaaaatgaaactgggcttcttgaaaaaggtcttcgtcccaaagatagctcagaagagtttaagcttccaggtacaaagcctgcatatgaaaggttccagttagttgcatgccctcaggaaagaaaccccagtgaatgcaagtcacaagaaatgttaaatcccaacagagaaccttctggaaagaaacagaataaaagagttaataatactgatgaaatggctaggctaattaggagtgtaatgcagctggaaaatggcatcttagaaattgaatctaagcagaataagcaggttcatgcttcccacacaccaggaaccgataaggagttggtgttccaggaccagaaggagcaggagaagactgaccatgcctttaggccagacagctctggaaaccctttgccctctaaggatcagccatcttctccaagacagacagatgatactgtctttagggatagtgaagctggagcgatggaggttaacagcattgggaaccatccccaggtccagaaaatcaccccaaaccccttcaggtcaagggaaggtgtacgagagagtgaacctgtgagagagcacacccacccagctggatcggacagacctgccagggatatttgtgattctttagggaaacacacaacttgcagagagttcaccaacacttctcttcacccacagagaatgaaagcattggctagagctctgccattgcaacccaggctagagaggtcttctaagaataatggccagtttgtaaaagcatcagcaagtctcaaagggcagccttggggcttaggaagtcttgaggaattggagactgtgaaaggttttcaggaaagccaagtagctgaacacgtaagtagttccaaccaagaagagccaaaagctcaaggtaaagttgaagaaatgcctatgcaaaggggaggcagccttcaggaagaaaataaagtgactcagaaatttcctagtctcagccagctttgtagggacacgtttttcaggcaggaaactgtcagcccattactaagccggacagaattctgtacagctcctcttcaccaagacctgagtaataccttgcccttgaattctccaaggtggccaagaaggtgtcttcatgtacctgttgctctaggcatctcttcacttgactgtgtgctggatctcacaatgttgaaaattcataacagtcccttggtaactggagtagagcatcaggaccagagtacggagaccagaagccacagccccgaaggaaatgttagagggcgttcctctgaggcacacactgcctggtgtgggtctgtgcgatccatggccatgggatctcatagtcaatctggtgtaccagagagcattcctctggggacagaggacaggatctcagcaagcaccagcccccaagaccatggaaaggacctcagaatcaccttgctgggtttcagtaccagtgaagattttgcttctgaagccgaggtggctgtacaaaaagaaataagagtcagttcactgaacaaggtctctagccagcctgaaaagagggtcagcttctccttggaagaggatagtgaccaagccagcaagccaaggcagaaggcagagaaggagactgaggacgtcggactgaccagcggtgtttccttagcacctgtttccctgccgagggtgcccagtccagagcctaggctgttggagccctctgaccatgcatccatgtgcctggccatcttggaggagatcagacaggcaaaggcccagagaaagcagcttcatgactttgtggccaggggcacagtcctttcttactgtgaaactttactagaacccgaatgttcttcaagggttgctggcaggcctcagtgtaaacaaatagaccagtcatcatcagaccagaccaggaatgagggtgaagcaccgggatttcatgtggcatctctatctgctgaagcagggcagatagatctgttacctgatgagaggaaagtccaggccacatctctgtctgcagacagctttgaatctctgcccaatacggaaactgacagagagccatgggatcctgtgcaggctttctcccatgctgctcctgctcaagacaggaaacgtcgtactggagaactgaggcagttcgcgggagcaagtgaaccatttatatgtcactctagttcttctgaaatcatagagaaaaagaaagatgcaaccagaacaccttcctcagctgatcctttggccccagacagtcctcgttcttcagcacctgtggaggaggtcaggagggtagtatcaaagaaggtagtggctgccttaccttctcaggccccttatgatgatcctagagtgactctgcatgagctaagtcagtcagttccgcaggagactgcagagggcataccccctggcagtcaggacagcagcccagagcatcaggaacccagaactctagacaccacatatggagaagtttcagataatttgttagtgactgcacagggagaaaaaacagcccattttgaaagtcagtctgtgacctgtgatgttcagaattctacaagtgcctcagggcctaagcaagaccatgtccaatgccctgaggcttctactggctttgaagaagtaccttccagggcctatgaaatggatgagacaggagagatctctaggggacctgatgtgcacttgacacatggccttgagcccaaagatgttaacagggaatttaggctaacagagagcagcacttgtgagccttctactgtggctgctgtcctatctcgagctcaaggctgcagatccccttctgctcctgacgtgaggacaggttccttcagccactcagctactgatggaagcgtggggttaataggggttcctgagaaaaaggttgctgagaagcaagcaagcacagaacttgaggctgcctctttccctgcaggcatgtactctgagcccctgaggcagtttagggacagctctgtaggtgaccagaatgcacaggtgtgtcaaaccaatccagaaccacctgcaacaactcagggaccacacaccctggatttaagtgaagggtctgctgagagcaagttggtggtagagccacagcatgaatgtttagaaaataccactagatgttttttggaaaagccacaattttccactgagttgagggatcacaatcgcttggattcccaagccaagtttgtagcaaggttaaaacatacctgcagcccccaggaagacagtccctggcaggaagaagagcagcacagagaccaggcttcaggtggtggagaaggcttcgcccagggtgtgaatccccttcctgatgaagatggcttagatggctgtcagattttagatgctgggagagaggaggtggctgtggccaagcctcctgtgtccaagattttatcacagggcttcaaagacccagccactgtgtccttgaggcaaaatgaaacaccgcagcctgctgctcagaggagtggccacctctacactggcagagagcagccagcacccaaccacaggggctcacttcctgtgactacaatcttctctggccccaaacactccaggtcctcccccacaccacagttctcagttgtcggctcttctcgttctcttcaggagctgaacttgagtgtggagcctccttcccctacagacgaagatacacaggggcctaacagattgtggaacccacatctcaggggctattcctcaggaaagtcagtggcaagaacatctctgcaggctgaggacagcaatcagaaagcctcatctcgcttggatgatgggactaccgatcacaggcacctgaagcctgccacccctccttatccaatgccttccactctctcacacatgccaacccctgatttcacgaccagctggatgtctggtactttggaacaagcccaacagggaaagcgagagaaactgggtgtccaggttaggccagaaaattggtgctctcagatggacaaaggaatgctgcactttggctccagtgacatcagtccctatgcgctgccgtggcgtccggaggagcctgcacgtatcagctggaagcagtatatgtctggcagtgcagtcgatgtttcctgcagccagaagccccaggggctgacactatcaaatcagcactgagaatgcccagggttcaaatgaggcctgggaagtattcc

SEQ ID NO: 461686 - DNA, 2558 bp, Homo sapiens
gaatacaaaccaccttctccaagcagggcatcaaaaaggcatcagagggttctggcaactagggtcagaaatattaccaaaaagtcctctcacttgcctcttggcagtcctttgaagagacaacaaaatacaagggacccagacaccatggtcccactcacagatttcagcccagtaatggatcattcaagagaaaaagacaatgatttatctgacacagatagcaactactcattggattctctctcatgtgtctatgccaaagccctgatagagccactgaagccagaggagaggaaatgggatttcccagagccagagaactctgaaagtgatgacagccaactatctgaggactcactggctgagaagaggtaccaaagccccaaaaacaggctagggggcaatcgtcccaccaacaaccgtggccaacccaggaccagaactagagcttctgtgaggggcttcactgcagcctcagacagtgacctacttgctcaaactcataggagcttctccttggatagcctgattgatgcagaggaagaactgggggaagatcagcaagaagaacctttccctggttcagctgacgagatacccacagagactttttggcacctggaggactctagtctgcctgtaatggaccaagaggcaatatgcaggcttggtcccatcaactacagaacagcagctaggctggatgccgtcctgccaatgagcagttcgttttaccttgatcctcagttccaaccccattgtgagctccaaccccattgtgagctccaaccccattgtgagctccagccccattgtgagcaggctgaatcacaggtagagccaagctactctgaacaagccgactctctccaaggcatgcagctttcaagagagagcccactgatgtccatggattcctggttttcctgtgactctaagatcaaccccagcagccccccaggaatagtgggttctttatgtccaagtcctgatatgcaggaatttcactcctgtaagggggagaggcctggatactggccaaatactgaggaactaaagccatcagatgcagaaacggttctgccatatagctccaaactgcaccaaggcagtactgagctcctctgcagtgcaagagatgagcacacagcctctgctgctgatacgtctaggctgtctctctggggaattcaaaggcttattcaaccaggagctgatggcacctttcagggcagatgtatccctgacatgacccagcagggcagctctgaagcatcccacaattctagcgtatcaaacgtgctggctgcctctgccaccaccttgactcatgtaggcagcacccatgaaagggattggtctgcccttcagcagaagtacctccttgaactctcttgtcctgttttggaggccataggagcacccaagccagcttacccctaccttgaggaagactctggttccctggcccaagcttctagcaaaggaggagatactctattgccagttggccctagggtatctagcaatctgaatctcaacaactttccagtccatctgtccagaatcaggcgtttgagggcagagaaagaacaggacagtttaaatgccaaattagaaggtgtttcagatttctttagcactagtgagaaagaggcgagttatgacgaaacttattcggcagacttagaatcattgtctgcttctcgatctacaaatgcacaggtctttgcaacagagaacgcgataccagattccatgacagaagcatgtgaagtcaagcagaacaacttggaagaatgccttcagagttgcaggaaacctggactgatgacttcctctgatgaggattttttccagaagaacgcttgtcacagtaatgtcactacagccaccaaagcagaccattggtcccaaggctgggctcctctcaggaaaaatagtgcagtccagccagggcaattaagtcccgacagccactacccactagaggaagagaagacagattgccaggagagctctaaggaagcagttagaagacacataaatgtttcctttgcccttccttcaggtccagagctataccttcactctgctccctggaatccattgtcatcttccctgcagcccccactcttggaaacattctatgtgaccaaaagcagggatgccctgacagaaactgccttagagattccagcttgcagagaagtaagggtaccctccccaccccccagggaagcctggggctttggtcacaaccaccaagctctccaaggtgcttatttgaagaataatttgccagtgctgttacaaaaccagaattctaagattgcctcatctcagcaggtcacagctgagataccagttgatctgaataccagggaagtcatcagagaatcaggtaaatgccctggaaatattacagaagaaagccatgattcagtttattcttctgttactcagaacagacattttctcccctctaccagcacaaaagtatgtgaatttgaaaaccaagttgtaattttaaataaaaaacacagttttccagc

SEQ ID NO: 461687 - DNA, 1665 bp, Homo sapiens
gacagccctgaggcggtcatgctgggggtccatgtgtgggcaccccaatccatactccagccgggctcccagacaccaaccagcatttactagcagctataaacatgtgtcatctagaacatccaacccagtcaacatctgaccacagtcaaatgagacacccctagtgagaaccaccgagccgagatcttcctggatttctaatccacaaaaccatgagcaacatcatatacggacacctccggctttcggaccattccattcaactcacaaccttggaaggaggcaagctccaggccatcggctccctgttcaacctctttgggcctcagttcccccatcgatccctgggccgctccctgggaagttctgatctaatatgtccaggctccttctgggatctgtttattaagcatcaggatgattcatatgactccgccgttggaacactggagcctgcgcgggtgtcaacgcttgttcacttgttacaggtgaggtcacccctttgtcacgcacctcgggccctgcgccctggtggtccagggctggtgcgggggcttaggtgcagcctctcccacgtgcacctgcgaggcctaccctttctcccgtctcagggccttgatgcccgtgcctgtgaagctggcatcagcgaagacctcagacgggaagggatgagtgagcaggagtatgagtacgtgagtttcgaatggaagcactgttatgccagcatcaaacaccctgcattgacagaaatgtgattccggcaaggtaataactgccactccctgggactgtttgacatgactccaggaccacagggagtgcatgaggaagctggcagtccacctgccacccactgtgaacccagacagagaggccatctgacccacacagcaattctgggggactgggacctgcgagcaaggttcgattcccagcccatccgtccctgtctctctgacacacggtcaccacgtgcattctgctgccaggccccggagctgaatcctgtgaaatccttgctccaggggccacacaatgtaaccgggaggcaggaatatgacaggaaaagttaacccacaggatgggaggtcccaggctgtgtgcacagtgacaggagtgatcacaagagtgcatggggactcaccctggccagagacagagaggcatataggaaggttccccaggggagccgagactctgtccagacctcaaagaattcggagaggagagtgagagtgagcccgtatctgggataactgaaaaaaaaaaatgactagcttaaaaaaaaatctccatgtgtgacaccttacgtcactaaagcaaagtgtggatttgagttactaggtactaacgagaattttggaaaatggacacagccctgcgtttaaaggaattgtcttttcttgctggctgatacacttgtaaacacacacacacacacacaccccacctggcatctccatataacatcccagggtgccgttagcctttctgcctcctccctcatcccatgtctcctagaactgccatgaagctgacgtgcagcatgtgctcgctgctgggcataggtggccagcccatggctccttcctgtacccgttgctggcaggtcccgtgccccggggcagctcctgccaccagtcctctcctctgccctccctc

SEQ ID NO: 461688 - DNA, 771 bp, Homo sapiens
atacaccgataaataatgagactgagctttttccagatccttaatcatattctgacacccaatatttgtcattccacagcgtctatgttcccatgtttatgtccagccagagtgatccagcaagaaaaagaaataaaaggcatccaaataggaagagcagaaatcaaactatttctttttgctgattatataattctatacccagaaaaccctaaagactcttccaaaaggctcctagaactaataaacgacttcgtcttctgcttatttgccactcaggtgatcagcaaaagctcagaaagagtggtactgatggagaggataaatgcttacccaaactcacataagttggcatatctgcagggaaacatcacgttagcctttgaggagagaggctatgcagggatccaaacaagaaaatgtgtaacaatttcagaagtggcaaaaagcaacaacgagatggaaaaagatgtgaaggatgtgacagtgaatgtgggtcacccccaaggctctttgtggcaagacaacgctggagcttctcctttgcatgaaactgattgatgctgcaaggtcctgaaggaagacagatgttttttgttttgttttgttttagtgcagttctccagtaaaaagaaaacccaggcggtgaataaattcagtcttctcctttgggagaagttcacttctactggggccagaatctgcttttacataccctgaactagaggatcagagtatcctcaaaaggctttcttggtacttcaactctga

SEQ ID NO: 461689 - DNA, 1033 bp, Homo sapiens
gctccacagtctaggtaaactgcaggacatttaaaaatgtttttgctttgttttaattttcaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaag

SEQ ID NO: 461690 - DNA, 1312 bp, Homo sapiens
ggaaggggatccgagcgggttgccctgaggttggggtcttaagcacaggaggcgggtcaaggcaaaaggagtaatgcaacgcctgtgaagccagccccacgcgcgcaccagtcgcgtaagacaacagcagtgtctccacctcggggaccaaggacgcctccgtgcctccagaccccgcctcctccagcccctgcacctgtcatttattcttccactgcccaataaatattcatggcagactttactggggctgcgcgcacacgtgcccgccgatcccggctgcctagcccttacagtctcccttctggtgaggccccgcctggggaccgtcaggccagcccaagttccgcagcttcaggggtgcgtgggcctccgctgagcacaaggggacaaccctgccccggccgcctggctcggtcccgaacgccgcgcctccagtccaaagtgggccagcgccgagcagggagccagcccgaacggcccaccgggtgcaggaatgcgagcgtgggccgcaggggctggctccatccctgcgcggctttcctctgccagccccgccttaagctcctcagaccctctttcctggctgcttcgccccgcccccgccccccgcaactccaggagctccgcgcggtcctgctcgcagtagatgctcagcgggtccaggtgctcctcgcagtggccctgcggcacctgggccagcccctccaccaggcgcgccagctgcaggttggtgctgagtgcctgcggccgcgtgggggcctggcagcaggggcagagaacggtgccatccgccgccggctccccggccacgcggccctaggcaggcgcggcagaaactgtggccgcactcggctgtcacgggcgcgtcgaacagctgcaggcacagcgggcaggacagctcctggtgcaggaggccgggcgcagccgacatggcgggcctgggtggaggaggactccttcctccttgctggcagcccctccccagcctgtcacccactcattccccaagtttatggctgaccaaggtcaccctggcaggattaccccacctgcaggagggcaggacctcaccccaccctgaaatgttttcttcctccagagctgaggggagggtcttttccactttggtctctctagtacacccaggacaagcctgggacaaagtaggcctctctaaatgcttggagaatgaatgatagagagacattgaacaaatgaatgaactgaatccagagcctgcagcccagaactcaattctgccctggttcctgtatgtgtatctttcaaatctcagctgaaatttcattta

SEQ ID NO: 461691 - DNA, 1615 bp, Homo sapiens
gctgcaggaaaggtaggacctgatggctccaggccctcggaggctcagaggcgcagggctgagccatgggaacgaagcgcgaggccatcctgaaggtgctggagaacctgacaccggaggagctcaagaagttcaagatgaagctggggacggtgccgctgcgcgagggctttgagcgcatcccgcggggcgcgctcgggcagctagatatcgtggacctcaccgacaagctggtcgcctcctactacgaggactacgcagccgagctcgtcgtggccgtgctgcgcgacatgcgcatgttggaggaggccgcacggctgcagcgggctgcgtgagggccactctgagctggaggcgggtcaaggcaaaaggagtaatgcaacgcctgtgaagccagccccacgcgcgcaccagtcgcgtaagacaacagcagtgtctccacctcggggaccaaggacgcctccgtgcctccagaccccgcctcctccagcccctgcacctgtcatttattcttccactgcccaataaatattcatggcagactttactggggctgcgcgcacacgtgcccgccgatcccggctgcctagcccttacagtctcccttctggtgaggccccgcctggggaccgtcaggccagcccaagttccgcagcttcaggggtgcgtgggcctccgctgagcacaaggggacaaccctgccccggccgcctggctcggtcccgaacgccgcgcctccagtccaaagtgggccagcgccgagcagggagccagcccgaacggcccaccgggtgcaggaatgcgagcgtgggccgcaggggctggctccatccctgcgcggctttcctctgccagccccgccttaagctcctcagaccctctttcctggctgcttcgccccgcccccgccccccgcaactccaggagctccgcgcggtcctgctcgcagtagatgctcagcgggtccaggtgctcctcgcagtggccctgcggcacctgggccagcccctccaccaggcgcgccagctgcaggttggtgctgagtgcctgcggccgcgtgggggcctggcagcaggggcagagaacggtgccatccgccgccggctccccggccacgcggccctaggcaggcgcggcagaaactgtggccgcactcggctgtcacgggcgcgtcgaacagctgcaggcacagcgggcaggacagctcctggtgcaggaggccgggcgcagccgacatggcgggcctgggtggaggaggactccttcctccttgctggcagcccctccccagcctgtcacccactcattccccaagtttatggctgaccaaggtcaccctggcaggattaccccacctgcaggagggcaggacctcaccccaccctgaaatgttttcttcctccagagctgaggggagggtcttttccactttggtctctctagtacacccaggacaagcctgggacaaagtaggcctctctaaatgcttggagaatgaatgatagagagacattgaacaaatgaatgaactgaatccagagcctgcagcccagaactcaattctgccctggttcctgtatgtgtatctttcaaatctcagctgaaatttcattta

SEQ ID NO: 461692 - DNA, 2869 bp, Homo sapiens
agggccgctgccgccgacggccatggaggacgagcagctcgacagcctggagggctgggcgccggtccggcaaggcctcttcgccgatgccgagaggcaccggctgcgcttcctggtggcgtggaatggcgcggagggcaagttagctgtgacttgtcacgacctcaccgcgcagcagccgcagcggcgcgagggggcccggctggggctggagcccaaacccaaggccgctgtgtccccgcccagctgccgtgtccccgcccagctgccgtgttcccgcccaactgggccggccggttctcggccgcgggcggcgctgtggccgcctctggaacgctgctccccgcagctggacgtgggcggcggcggggcctggagtctggggctcgggctgtgggcgctgctctggcaggcgcgcgcgggccccggcgaggtggcgctgcaggagctatgcgggcagctggagcgctacctgggcgcggcggcccacggctgcggcggcgccaccgtgcgccacgctgttttcgcggctaaaggccgcgcggctgactgcgagagcccgcgcgagtttcgagagcgggccctgcgcgcctgatgggtcgaggcggacgcgcggctgcgtcagacagctgccttcttaactgagtgctcatatagcctttcttctgtgtgtaagtttagagagaaagaaagtgatccctgtctttctcttctaatggcactaatcccatgatgggggtgctatccttttgacataatctgaacctaattacttccaaaggacccacctccaaataacatcacattgggagttagagtgtcaacatatgaattttgtggggacaccaatatgcaatacataataatacctcattgccatttatgtttctcaaaacctaaatgtttttctgtttcaaggatgagataaaatattagcatcactagatgaaatgaaaaagtgtttctttcctatttgcttttttatatttagtattgaacaaggaatagaaaatagctagaatgcttctgaagtttgtttttaatatactatttattttaacttatttttcttttttctatgaaaataagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaagaaatatttaatttttatgaagtcgtgtttattgattttttcccctatggcttctgcttttagtattatgtctggcaataggctcctatcccaaaattatgtcaatatatacttatgttttctttcagtatgtttatgatgttactttttaaaacatttaattctttagtccaggtggaatttattttgaatgtggtaggaattgaacctttccctcaaattgttaagcagtcccaatcactgattttaaaaacattttccctaaatgtttaacatttctccagttaagcattagattgactttggtctgtttctgagttgttctcctccattggttcgtgagtggcttctgctgctggctccatactgttcccacgactgtcttggaggcacattttagggtctgtgatccgcccaccttggcctcccaaagtcctgggattacaggtgtgagccactgcccctggaccacagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461693 - DNA, 740 bp, Homo sapiens
ctggcattttacttgttcccaactaatttttcttctaatgacttgaaaagtatatgtttagttcctatatctttatatttttatacacatagctacacatatgattgacatccagagctaatcgtatagataaaatgagactcctagcatgcttttacttctctctccttcctcctttccagacttcataactttccatcccgagttatttcagattttagttttttattataggtttatttttataatttagacttaaaagtaaacttcactgattatcttgctcacctgtgcttcttatatccctttttttcttcccagatttattttctttttgaatatattttctacaccatggtttctcaaccagaggtgatacagcactgtctccaaatgtggggctgttgtgtattgtcacggggaggagaaatgctactggcatttagtggatgatggtcaaggacactaagcaacctgcaatgtgtggatcaatcttacacaacgaaggactgttccaccccaaatgccaatggtaccctgttgagaaaggttagtctatgtggacagtgaattataaactttttgaatctgtttttggtcttaaaatgtctttatgatgccctcacattcacttgcactttggctggttaaacaatattaaaagaaaacttcaaattaaatggaatttaattgagcaagaaaaaaaaaacaattcacaagttgggcagcctccagaacca

SEQ ID NO: 461694 - DNA, 246 bp, Homo sapiens
ggtaattggcatctgcaatttcatgcagtctaagtgaaacccataaagatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461695 - DNA, 2636 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaagaaatatttaatttttatgaagtcgtgtttattgattttttcccctatggcttctgcttttagtattatgtctggcaataggctcctatcccaaaattatgtcaatatatacttatgttttctttcagtatgtttatgatgttactttttaaaacatttaattctttagtccaggtggaatttattttgaatgtggtaggaattgaacctttccctcaaattgttaagcagtcccaatcactgattttaaaaacattttccctaaatgtttaacatttctccagttaagcattagattgactttggtctgtttctgagttgttctcctccattggttcgtgagtggcttctgctgctggctccatactgttcccacgactgtcttggaggcacattttagggtctgtgatccgcccaccttggcctcccaaagtcctgggattacaggtgtgagccactgcccctggaccacagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461696 - DNA, 2348 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461697 - DNA, 2879 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaaggtaaagtttatatttaagtatatagattacaatgtttataaatttaaggaaatacagaccatattatcaattactttttgtaaactgtaacatctgaaaatttcctaaagttttccttcagtagtttattattcaaataatatattcattgttagcacatagcaaaacaaagaaagaaaaatgattattacttcaatcccatcatctagagatgcttagtgtttggctgggcacagtggctcacgcctataatcccagcactttgggaggctgaggcgggcggatcacttgaggtcaggagttccagaccagtctgaccaacatggtgaaaccccatctctactaaaaatacaaaaatactaaaccctgtctctactaaaaatacaaagtccgatgtggtggcacgtgcctgtaatcccagctacttgggaggctgaggcaggagaatggcttgaacccgtgaggtggaagtttcagtgagccaagatcgtgccactgcactccagcctggaagacagagcgagactccgtaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461698 - DNA, 2582 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaagaaatatttaatttttatgaagtcgtgtttattgattttttcccctatggcttctgcttttagtattatgtctggcaataggctcctatcccaaaattatgtcaatatatacttatgttttctttcagtatgtttatgatgttactttttaaaacatttaattctttagtccaggtggaatttattttgaatgtggtaggaattgaacctttccctcaaattgttaagcagtcccaatcactgattttaaaaacattttccctaaatgtttaacatttctccagttaagcattagattgactttggtctgtttctgagttgttctcctccattggttcgtgagtggcttctgctgctggctccatactgttcccacgactgtcttggaggcacattttagggtctgtgatccgcccaccttggcctcccaaagtcctgggattacaggtgtgagccactgcccctggaccacagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461699 - DNA, 1504 bp, Homo sapiens
atccctgctagccgcaatttgttggactctcttaaaagattataaaagatgaaatttagaatcaagttcaaaacaaaaaactctttggaattttgattgtgattttgcttaaaattagagattactttggggagaatagtggtctttgcaattttgaatcttcctacccaagaacatgaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461700 - DNA, 1137 bp, Homo sapiens
atccctgctagccgcaatttgttggactctcttaaaagattataaaagatgaaatttagaatcaagttcaaaacaaaaaactctttggaattttgattgtgattttgcttaaaattagagattactttggggagaatagtggtctttgcaattttgaatcttcctacccaagaacatgaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagatttattttctttttgaatatattttctacaccatggtttctcaaccagaggtgatacagcactgtctccaaatgtggggctgttgtgtattgtcacggggaggagaaatgctactggcatttagtggatgatggtcaaggacactaagcaacctgcaatgtgtggatcaatcttacacaacgaaggactgttccaccccaaatgccaatggtaccctgttgagaaaggattcaagatggattggcatcaaagttcacttctttaacaaaagtgctttatgaccttaataaaatattagagaatggtaggatccatggaagccctttacaaaaacttgtgatagaaagttttgatgataagcagactttgcaacaactggaattgcaaaatgacccaattttacaaagcttccagaatgcagttagtgaaacaaagatgaagatatcagtatcccagagagtgaagaacaggagcatgaagaggatggttcagagacagaggctgatggccaggaggacctagaagatttagaggaggaggaggaagtgtcagatatgggtggtgacaatcctgaagtgagtgagagagcaaactcaagcaaattcgatccgacgaaaagcccagttctcagtgatgaggattctgaccttgactttcatatcaacaaattggaacagcagagcaaggtgcgaaacaaaggacacgggaaaccaagagaaaagtccatagcagacgagaaattcttccaactctctgaaatggaggcctattta

SEQ ID NO: 461701 - DNA, 782 bp, Homo sapiens
atccctgctagccgcaatttgttggactctcttaaaagattataaaagatgaaatttagaatcaagttcaaaacaaaaaactctttggaattttgattgtgattttgcttaaaattagagattactttggggagaatagtggtctttgcaattttgaatcttcctacccaagaacatgaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagatttattttctttttgaatatattttctacaccatggtttctcaaccagaggtgatacagcactgtctccaaatgtggggctgttgtgtattgtcacggggaggagaaatgctactggcatttagtggatgatggtcaaggacactaagcaacctgcaatgtgtggatcaatcttacacaacgaaggactgttccaccccaaatgccaatggtaccctgttgagaaaggttagtctatgtggacagtgaattataaactttttgaatctgtttttggtcttaaaatgtctttatgatgccctcacattcacttgcactttggctggttaaacaatattaaaagaaaacttcaaattaaatggaatttaattgagcaagaaaaaaaaaacaattcacaagttgggcagcctccagaacca

SEQ ID NO: 461702 - DNA, 1794 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaaggtaaagtttatatttaagtatatagattacaatgtttataaatttaaggaaatacagaccatattatcaattactttttgtaaactgtaacatctgaaaatttcctaaagttttccttcagtagtttattattcaaataatatattcattgttagcacatagcaaaacaaagaaagaaaaatgattattacttcaatcccatcatctagagatgcttagtgtttggctgggcacagtggctcacgcctataatcccagcactttgggaggctgaggcgggcggatcacttgaggtcaggagttccagaccagtctgaccaacatggtgaaaccccatctctactaaaaatacaaaaatactaaaccctgtctctactaaaaatacaaagtccgatgtggtggcacgtgcctgtaatcccagctacttgggaggctgaggcaggagaatggcttgaacccgtgaggtggaagtttcagtgagccaagatcgtgccactgcactccagcctggaagacagagcgagactccgtaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaaggtaggtacgctcagagcggctttcttttcttttctcttccagagatttattcttgt

SEQ ID NO: 461703 - DNA, 1406 bp, Homo sapiens
ctccatgttggtcaggctggtgtcgaagtcctgacctcaagtgatccacccgcctcggcctcccaaagtgctggaattacaggcgtgagccacggtgcctggccaaaagtctccatattattaaacaatcttcagaagcacagtgctgaatgactacagtaataatattctgccatggatatatcataatttacttaacaattcttgttttattgggcatttttgatggaggatgatgacattttcatatttaatcaatattttaaattgatgtattgaaagttgagaacatgaaggtttcttttgtttagttttgtttgttgggtatgtattacactgtctgacttgagctttattcacatttgctctctaggttatccaaggacatggctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagaaaaacaggatgaagttgtctattacgatccatgtgaaagtccagaggaacttagtcattgactgtggtggggctgcaggacgataagaattcggaagtgaaagaactcagaaggcagtgccagcagctggagtctgttaaacggggcagtctgtgtcaaaagagcttctctccagagtagaaagatttattttctttttgaatatattttctacaccatggtttctcaaccagaggtgatacagcactgtctccaaatgtggggctgttgtgtattgtcacggggaggagaaatgctactggcatttagtggatgatggtcaaggacactaagcaacctgcaatgtgtggatcaatcttacacaacgaaggactgttccaccccaaatgccaatggtaccctgttgagaaaggttagtctatgtggacagtgaattataaactttttgaatctgtttttggtcttaaaatgtctttatgatgccctcacattcacttgcactttggctggttaaacaatattaaaagaaaacttcaaattaaatggaatttaattgagcaagaaaaaaaaaacaattcacaagttgggcagcctccagaacca

SEQ ID NO: 461704 - DNA, 2362 bp, Homo sapiens
tctacaggatctccggcactgcttcggatggtgcctgtgattacagaggaaatacctttcaactggaagatatcattaaacacaggaaaagagatcaggttatccaagggacatggaaaagccaacaccatggtagcattaatgaaagtttaccaagaggaagatgaagcctaccaggaattagttaccatggcaaccatgtttttccagtacttactgcagccatttagggctatgcgagaagttgcaactttataattccttggatgaggatgacgtaggtcctacgtctccaggatagttgccctggagaaagaagctgaagaatggaccagacgggctgaagaagctgttgtctctattcaagatatcacagtgaattattttaattagacagtaaaagcattagcaggaatgcagaaagaaatggaacaggatgtgaagagatttggccaggctgcctgggccacagcaattcccaggttggaaaaacttaagctaatgctagctcaagagactctgcaactcatgagagcgaaagaattgtatttaaatcgcaaaagagctgaaattcagggaaagatggaagatcttccagaacaagaaaaaaatataaatgttgtagatgaattagaaatgcaattttatgaaattcagttagaactatatgaagttaaatttgagatattaaaaaacgaagaaatactgcttactacacagttggactctcttaaaagacttataaaagaaatatttaatttttatgaagtcgtgtttattgattttttcccctatggcttctgcttttagtattatgtctggcaataggctcctatcccaaaattatgtcaatatatacttatgttttctttcagtatgtttatgatgttactttttaaaacatttaattctttagtccaggtggaatttattttgaatgtggtaggaattgaacctttccctcaaattgttaagcagtcccaatcactgattttaaaaacattttccctaaatgtttaacatttctccagttaagcattagattgactttggtctgtttctgagttgttctcctccattggttcgtgagtggcttctgctgctggctccatactgttcccacgactgtcttggaggcacattttagggtctgtgatccgcccaccttggcctcccaaagtcctgggattacaggtgtgagccactgcccctggaccacagacggagtctcactctgtagcccaggctggagtgcaatggcgcgatcttggctcaccgcaagctccccctcccgggttcacgccattctcctgcctctgcctcgcgagtagctggaactactggcgcccaccaccacatccagctaatttttttgtatttttagtgcagactgggtttcaccgtgttagccaggatggtctggatctcctgaccttgggatccgcccgcctcggcctccgaaagtgctgggattacaggcgtgagccaccgtgcccggccgagacttttaattatgcaatgccagactgcattgcataaaccaaaggccaacagagaggtgacctttcaaattactggcacaagaagagccgagatcagaaagctccaacttaatgcaaacatcgacaagaaatccgacagaaatgacttctgtgtctggtcaacttaacataacatgacatattgtcaagcacatttggctttttaggtagaattgtctataaaggtttaactgctttagaaaatataaatgtgaagatttgtggtatttgggtttatatataagatatttctacattgaaaagagacagtggaaaagcttggtataagatttgtaaaatatgtttgtaataatgctaatggaagaggtgagatttgggtggggtggggtgtagatgggaacatggtttggggattggggaaagggaagtcatgctgttaataaaatagtgaggcatgttgtataaagtgtgttttatgtctcaattgaaatgttatagagataaatttaaaatagatcatgatgggttttgaatctgatttctaattttaaaatgttatgagcttttgttgctttcctatttcatacacatttctttatgggtttcacttagactgcatgaaattgcagatgccaattaccttttaacaaaattaaattcacatatatgtataatttacatgtatatattcatggaattttttattctacacgatatattattttaaaatggtttttcaatgacaaaataaaaagtatttttctatactttcagttttctggtttgaattttttctggcaacactaattttcacctacctatactcattgatagtataaaattgtacaagtgcatatttt

SEQ ID NO: 461705 - DNA, 594 bp, Homo sapiens
  misc_feature (17)..(17): n is a, c, g, or t
  misc_feature (22)..(22): n is a, c, g, or t
  misc_feature (26)..(26): n is a, c, g, or t
gcaggctggtaccgccnagggngtanggatatcgtcgacccacgcgctccatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461706 - DNA, 333 bp, Homo sapiens
tctgtgaaatctaaaatatttactacctggcctgttggaggaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461707 - DNA, 449 bp, Homo sapiens
tttaaggtagtttttatttacagctgggaagtttctaaacactccatgaagctgttgaaataactttgagacttcttggtaccagcttcttgatcagtccatcattatttggagctgtttttctgttccgaaacaccaatgtggaagatgtccttaatgcccgaaaactggagcgagactcacttcgggatgaatcccaaaggaagaaggaacaggacaagctggatccagattttatgttaacatggcagcaaaactaggaaaatgggaagaaattacttgcggggtgttctagatctgattttttttttttttttgaaagtttcagccttgatttttgtcactgaaggagtcaggttatatccacggtcccctgaagggtacttgtttcaatttgttagtagtcagttctttcttctgggactctgctatgtatgtcacagttaagt

SEQ ID NO: 461708 - DNA, 2579 bp, Homo sapiens
tctccttcagttctcctcctcagtgaaggtggtagccgtcggtagcgacgacgagggtattccaggctgtcaggaggttcttgccagacagctgtgtgggagtgggcggccagcatcccccgaaagcgcggggaaggcagctcggtcgggtggaggaagcgatggcatccacgctgagctccagtcctgggtagttattagccgcgtgactttggccaaattactgcacctctctcaacttcccgaactgtagaatgagtctgttaagaatactcacatgccaagcatcttgtgagatcacgcgaccgcacgtatgcgaagacgcgcttcatctagaaagcacaaaactctcaagccggccgacacggctgcgctctttgcacttacgggcctgggcttcctcttcaggcatgcgcggtggacctgcggcgcggcccgtcaggcactgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461709 - DNA, 2094 bp, Homo sapiens
gctgtactggccggaatttttgggatcgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461710 - DNA, 2025 bp, Homo sapiens
cggacgcgtgggtcgagccacgcttttcggcggtcccgcgggtctgtctcttgcttcaacagtgtttggacgtaacagatccggggactctcttaccagcctccgaccgtccctccgatttcgctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggatgaagcagatgagaaggatgattcaggtgctaccacaatgaacattggttctgacaaacttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461711 - DNA, 3351 bp, Homo sapiens
tctccttcagttctcctcctcagtgaaggtggtagccgtcggtagcgacgacgagggtattccaggctgtcaggaggttcttgccagacagctgtgtgggagtgggcggccagcatcccccgaaagcgcggggaaggcagctcggtcgggtggaggaagcgatggcatccacgctgagctccagtcctgggtagttattagccgcgtgactttggccaaattactgcacctctctcaacttcccgaactgtagaatgagtctgttaagaatactcacatgccaagcatcttgtgagatcacgcgaccgcacgtatgcgaagacgcgcttcatctagaaagcacaaaactctcaagccggccgacacggctgcgctctttgcacttacgggcctgggcttcctcttcaggcatgcgcggtggacctgcggcgcggcccgtcaggcactgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggaatatcctttctggagtctcggcaccattccctaaagctcaagccagacatatttgtgggtttacagtgacctttggcaagttgctaatccccctctatagcttaattttcccctctaaaatggcagtaatctatggccctttgtggatatgcggagtgatattggattagttgatactggacttatatttttcaacacataatcattatattcctgaaaactttggtgtaaaacaaataatgtcttaatagtccatttatattatgctttcagaaaatacaatatagctattcagtgtgtatggttattagaatgtggttttcacttcagctttagtagtctaggaacaaaagcaaattgataaagtttaataaggttaaacatcttatttaactcttttaaggcattttaacagagccaagtacataaacatttagtcagttacattactactctgttcaccaaaactagcctagattctctaatattctgccattgaatgatataagtacttattctagaatgaaatttcattttgatgaaatattttgttttcttatttttttgtttctttggtaaaatattttaaaattcagatttaggtaaatctgaataagagttttattccaaaggacattttaaaacttttgtaatatagctttaggatttctctgttagaccaaggataaacataagggttttttttaaaaaaccaggaatagataaagacgattcaggactcagcaggtggagagaggataagtagaatgaggaaaggcagcagtaggtgtgatctgtgtgacctgtaccctaatcccttaactcacctgtttctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461712 - DNA, 2520 bp, Homo sapiens
tctccttcagttctcctcctcagtgaaggtggtagccgtcggtagcgacgacgagggtattccaggctgtcaggaggttcttgccagacagctgtgtgggagtgggcggccagcatcccccgaaagcgcggggaaggcagctcggtcgggtggaggaagcgatggcatccacgctgagctccagtcctgggtagttattagccgcgtgactttggccaaattactgcacctctctcaacttcccgaactgtagaatgagtctgttaagaatactcacatgccaagcatcttgtgagatcacgcgaccgcacgtatgcgaagacgcgcttcatctagaaagcacaaaactctcaagccggccgacacggctgcgctctttgcacttacgggcctgggcttcctcttcaggcatgcgcggtggacctgcggcgcggcccgtcaggcactgcggtaggcgccctaggggcttgcaggaccctgaccccaagatggcggcgcccagcgaagtggccgcgatagcccctggcgaaggcgatggcggaggcggcggctttggctcctggctggacggacggttggaggcactgggagtggaccgagccgtttatggagcctacatcttgggtatcctgcaggaggaggaggaagaagagaagctggacgctctgcaggggatcctctctgctttcctggaagaagattccctccttaatatctgcaaggagattgtggaacgatggtcagaaactcagaatgttgtcaccaaagtgaaaaaagaagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggattctgttccgaaacaccaatgtggaagatgtccttaatgcccgaaaactggagcgagactcacttcgggatgaatcccaaaggaagaaggaacaggacaagctgcagagggagagagacaaactagccaagcaggagcgcaaggaaaaggaaaaaaaaaggacacagagaggggagcgaaagcgataaccttggcctactctattctttccccccatgaacttatcaaagggagaactggttgtgtatttaagagaaatgagagtgcattgcaaagtagtttcccaaggcatttcccctattgtttacatggtcaaaaggaaaatcaaaatcacttctaattacaaaatgtgctgttttggtggggtgggcaatcagattattatagttgatgactgtaccaaagatctggaatgggggccacctttatattttaatactcaagtcctgtgctccttttggccactttaaaaagtcttccctcaccttggataaataggattcagaaagctaacagttttcattctgaaggagcagaaacataatcaatccctccctgagataaaatgtgggcatgcacattgctttggagtcagtattcagctgtaagtgtagtattgttttatggctgaaatagaaagctaatgaagaggcctacctggatccagattttatgttaacatggcagcaaaactaggaaaatgggaagaaattacttgcggggtgttctagatctgattttttttttttttttgaaagtttcagcctgtgggaggaaaagaggtatcttttaaaatagagatagttacatattttcctcatctaggctgtgtcactattgggtgcaaggatatcattgttggctagattcattttgtataatcatgtatcctcttgtgtgctggtagagattttaatcctgatttttccataaaacatgagtattaagaaataattcctggtttggagaaactggagaaatcacccttttaaggaagaaacactggaaatttctgctaacaccaagatatttaagagtgtacatagtaggtgctcaacaaatttattgaatgaatgagtgaatggaaaaactgggagagtcaaaagtgagcagaagctctccatttctacttctgtcacaaaccacattaaattgtaaataaggcccttctccacttgacttcaggcagcagattgtctagaagcctaaggacagcaatttctctgacaagacaaagtagatattttataccaggggttggcaaactactgcccacgggccgaatttggcccagtctgtttttgtatggtgcaaactaaaaatgatttttacatttttaaagagttataaaagaaaaaaatatgtggtctgtgaaatctaaaatatttactacctggcctgttggaggaaaggtttgccaatctctgttttataccattaactatgagattaacaaaaacttttacctttgtgcagaaggttaaaaaaaaaaaaacatggttaaggaaaaggagacatgttacctcttcatacactcctataactgtggcattgcaaaaaataaaaataaccacctttaaaaaaataaatcttatttaaattgc

SEQ ID NO: 461713 - DNA, 400 bp, Homo sapiens
tttttttaaggcagcagaacttcagtatataaaacaagtaaaatcagggctgctctgattgaagatggatacaaagcttggcctgcatggcctttcctttcctttctcaatggcccccgagccatgtcctttgaactgccaggctctaaggaggcagcagatgccaatgtcttcagtacaagtgctgcctatgtggactagtggttcagtgagcttgttctctctcatacaaccttgttcttccttccaccacctcccagatgaagtacaggccattgccaccctaattgagaagcaggcacaaatcgtagtaaagccaaggatggtgtcagaagaggagaagcagagaaaagctgccctcctggcccagtatgctgatgtgacagatgaagaggaatat

SEQ ID NO: 461714 - DNA, 2389 bp, Homo sapiens
ggtgtctggttttctgttcttgtgttagtttgctgagaatgatggttttcagcttcatccatgtccctgcagaaaacatgaactcatccttttttatggctgcatagtattccatggtgtgtatgtgccacattttctttatccagtctatcactgatgggcatttgggttggttccaagtctttgctattgtgaatagagctgcagtaaacatatgtgtgcatgtgtctttatagtagaattatttataatcctttgggtatatacccagtaatgagactgctgggtcaaatggtatttctagttctaggtccttgaggaattgccacactgtcttccacaatggttgaactactgtacactcccaccaacagtgtaaaagtgttcctatttctccacatcctctccagcatctgttgtttcctgactttttaatgatcgccattctaactggtgtgagatggtatctcattgtggtttcaatttgcatttctctaatgaccagtgatgatgagctttttttcatgattgttggctgcataaatgtcttcttttgataagtgtctgtttatatcctttgcccactttttgatggggttactttttcttgtaaatttaagttatctgtagattccaggtattagccctttgtcagatggatagattgcaaaaattttctcccattctgtaggtttcctgttcactccaacgatagtttcttttgttgtgaagaagctctttagtttaattagatcccatttgtcaattttggcttttgttgccatggctttttgtgttttaatcatgaagtcttcgcccgtgcctatatcctgaatggtattgcctgggttttcttctagggttcttagggttttaggtcttacatttaagtctttaattcaacttgaattaatttttgtatagagtgtaaggaaggggtccagtttcagttttctgctcatggctagccagttttcccaacaccgtttatcaaatagggaaacctttccccattgattgtttttgccaggtttgtaaaagatcagatggttgtagaggtgtggtattatttctgaggcctctgttccattccattaatctatatgtctgttttggtaccagtaccaggctgttttgttactgtagccatgtagtatactttgaagtcaggtagcatgatgcctccagctttgatctttttgcttaggattgtcttggctatgcgggctcttttttggttccatatgaaatttaaggtagttttttctaattctgtgaagaaagtcaatggtagcttgatggggatagcactgaatctataaattacttttggcactatggccattttcacgatattgattcttcctactcatgagcctggaatatttttccatttgtttgtgtcctctcttatttccttgagcagtggtttgtagttctccttgaagaagtccttcataatctcttgtaagttgtattcctaggtattttattctctttgtaataattgtgaatgggagttcactaatgatttggctctctgtttgtctattattgatgtacagaactgcttgtgatttttgcacattgattttgtatgctgagactttgctgaagttgcttatctgcttaaggagattttgggctgagatgatggggttttctaaatatgcaatcatgtcatctgcaaacagagacaatttgactccctctgttcctatttgaataccctttatttctttctcttgtctgattgtcctggccagaacttccgatactgtgttgaataggagcaatgagagaggtcatccttgtcttgtgccggttttcaaaagacatgcttccagtttttgccccttcactcaacgaggagccagccccgtggctcaagcacctgctggcttgcccaggtgctgctcgccacgagtctgttcgccttgtcctcacgcccctgtccacagatggatggagttaccgaacggcctccacgccgcgcttcacttatccccgctcacagcccatcttcgggctgttcataatgacaggcggtccctcgaaatgtgcagtgaattccacggacaacggaaaggcagctctatctgaaggtgaaactgctctagctaacagggaaagctctttaaaagaccatcaaagagacaccctgcacaatgcctgctttccggaggagcctcgcgcccacaaggccatcccccaaatccaaaatatgctggcatgctaatcgcgtgagacaacttggcccacggacagccacaaagcacaaaaacaaaacacaaactcactcagagaagaaacaagaatcgtgttttcctggcatctacgagaagcgctttattagaagcgctttatttttcctctagatttcttttct

SEQ ID NO: 461715 - DNA, 5535 bp, Homo sapiens
  misc_feature (1)..(1): n is a, c, g, or t
  misc_feature (5)..(5): n is a, c, g, or t
  misc_feature (9)..(16): n is a, c, g, or t
ncctntccnnnnnnnnggagtctggaatggaaactgactttggggagcctgagtggggcaatgactccccagcagctgggggttcactcttcctctcatgctcttgatggagctggtggtctgggggtcttactccttggaggccgtgtggaccataaggtccaccaccctgttgctgctgccaaattcatcccaggaaaggagcctgacaaagtggccattgaagaccatggagttgaggccagtgaagagatcattgatgatgacagtgtccattttgccgagttgaaagctgccctggtgaccaggtatccaatatggccaaatccattgactcagactctcaccattgtatcctggatgaggctgacactgcatgagcagatggagctgtttgctagctctgaaggacagatgtcttcccccgagaggcagctgctctcagatgaggagctaacctacgaatgcatcagatgtcccaataaagtctccctggagctggaaagtggcattactgaaacattccagaaacgagctgaagtcactcaaggaaggccttgggaactagggtttggcccggtgggcagcgcatggtagacattcacacgcgctccagcactgaacactgcgacctggcagggagctcacagtattgtgggagaaatgaagaagtaaatagttaattttaagataatgtagtggctgtgagatggaagttttcagggtgttaacagggatgggggacctaaccagtggctgaggaggaagacaggcaggggtgagaagtattgggaaaggcttccagaaagagttaatgccttcaagtctatttcttcctatcatccgtgagggggatatgtgggagaaaagttaggaattcacaaaccccaccatgcatccgatgagaaggaaaaaattttccttccaattttctatgcgatgctattattcctagggtcctcatgacttatattagtgaacatttttttgcctctcattttgaacatgaattcaatgaaagttaattaaaatgatgtaaaatgtgaccttgtgtgaattaattaatgttagtaaaaatgagcctttttccccctttttttttttcaattactcacatatggaaacccaagaaaacatttgccatcacttgactaagcactgtcaggactcatggttttcaacatctttctcctgcttacaaccataagaacaggcaggtggccaatgaggggaggagggtaaaagcgagaatttgttacgctggaattcagcagagcctctctctaacatgtggggtttaagattagtggaatcatgagtaagagaagtgggaaagagtataaactaagaatctacttagaaagctgactgagccactaagaaaggggttgtggtagtcagaaactctttctctgctcttctcaaagaacatggaacaaaatatcagttgagtcatttggaatgcatttggctgcaagtaatagaaaccctaattcatcataattggaacaattagatggtttgttatctcacataagaagaagtccggggggatggcagttccagggttgattaattcaccagctcaccagtgtcttaaagatccaggttatttcgatgtttctaccctgccatccccagtgttctggtttatcctcataggctgctgtcttaatggacccaaggtgctttggttccaggaacaacacacagagcccaagtccagaggcagaaaagcaaacatttttatcttgtggctttttctttttttttccaagagaaaccttcccagaagccccatcagcagatttccttttttagctccattggcccaattgcgtcacatgcctgaaccaattgtttagcaggggaaatcactccgtcctctctagcttcaaccatgaactctcagtcctgggtaagagggcagcctagccttccctaaaggacttggtaacttggaataagatgaacaaaatcagagttctatgaacaacgaagttgggggatggcagaggggacagcgactaacacgtccatgttaaacaagagttctctgctttctcttcttgaacttgaggggcacagccttggggatttgggggatgcccctttgatcatctcatttcttctccttggtagcaagtaattgatagaatcacaccagaaaaaagagcaaaatatgacaaagaaacaactttaatacagtgaggatactggggaacagaccagatgtgagcagacagggaagtctttagcaaaactgtggagtgcccaaagcttggcttctgatgcgtggagcctttccgttttgtgttcttcctcctcactccacatcccacccaagaaacctggtattttaatattctcctctttgctccattaaagcatcaaacatattcacacaaggtttacgtgaccaaggagtgcaagatagggattaaaaaatagacttgaaataccagctctgccatctgctaactttctgaccattttgggcctcaagttcctcaccaacaaagtgagaataatgatactacccagcaggttgttaccgctatgtttattagtgttcatcctattggagcaagctgactgctaacaactttaaaatcatgatggcttaacacaagtttgtttctcactaacacagagtctagtgtcgatggtcctgatcgggtggctttctggtgacctgaggactcaaggatactgcccttgcattttaaggtgccactgtcttcaacacaggatctttaggttttctctctgccacattattattatggctgttgctgttattgtaactaatcctgtgtattgaaacggcagtcattttccagatgtaactacggtaccctaacagttcactgatgttcatggccataattccaggaagccatttctgagagcttatgtaccttaaatcccagtttgaggtgtctagggaagagacaatagtccattaaggatgacagcagggaagtctagtaacttctctcctctccacgatacttagcatggtgttggacacagcaggtgctgacccagtgactgtggcacttactcatggtggatgcactactctatttccttgggtccctttcccattttcacaccccttggctccacgtttgcttttactctcggtatccagaacccatgcttctttgtgagagggctgccctcatgcttctggagtctcctttacctgtgtgcagagagagtgggggatacctagaaacatgcatccctctgagatggcccttgaccaatggagggaggggctctcagtctccaaatctcctctgtgggaggagccagtgccctgcaagcacgggaccttgcttgacattgcactcttgcttggcttccttctcactgtcttgcatcctcacttccctgcaggggacactgcccaacacatcactttctcacaaatctgcatctctgggatgcttctggggaaccagcctgagacaggaggtaagctgaagaagcagaattttgaagattctgggctctgtttgaatggaatagctgagacgggtctttgagaacatcagtatttgcctcccacctcagtttttacattcacaaattaaaggatcacacaggcagactttggtatgatatgcagttcctgagcagtgttgggactcaaagacgtttatggcagctcatcagcctgcatccagtgcttcaaagggttctaagagactggctcagccaactgccagcctggtcatttcgaaactgaaatgaaagcagcagagagagttatatttatcaactgagtgagacttgcttttctcaacaggatatttacgttgtgaactggtaaaatctgaactgcagaatatcagtttccagacattcttcctagatgatgccgtctgccacgggtcccttcctctctccagctgtctggaatggagctaccctgtctggtgcccaagcagccagctctgacccagagttaacatattatggattgtggagccacaggatggagtagcctgggtctgatggttctgttagtcaaggctagtcaaagaagcaggaccaacaggaaatacatatgtttatgtatgtatatgttatgtatatgctatgtatacacatacacacacacacagatacacagagagagagagagttaagaaagtggatcatgtgattgtggggctggcaagttcaaaatctgcagacccacagaagagctgatgttgcagctcaagtctgaaggcaatttggaggcagaattcccacttcttcaggggacctcagtcttttctcttaaagccttttactgattgaatgaggcccacccacattatgaagggtcatttgctttactcaaagtttactgatttaaatgttaatcacataaaaaaaaccttcacatcaatgctggtgggtgattgaaggtgggttattatgacaaatgcaatgaaataataaatgtggaagggcttctcacagtgcctgcctcagagtggaaactcaataaatactagggcattctgtgtctgaaaatctcacctctaattattctcttttccttccctattatacaaaacagcagcagcagtaacagcgaccacaaaatgcactccaagatacttctaaccatttcttgctgggggaatgtttgcatccttggttagttaaaacttttgtgttcctcccatgtcagaagcccctggatcttgtgtgaagctgtgcattccctgattagtttgtttctgtccttctgtggcttgttctaaagggctttgctgctgccttcatctggggaaattcacacactaatgcagtggtatctcatcccaatctattaggtgtgacaactactggcaagaaatagatttgtgtttaattctttgttgcccagcagggacctctatcacccaaagggaaacagccgtctatctacgaagctgtgatctcccctacaagcaagagaactcaattgccaggaggtctttgctttttctggcttccagagaatgcagaaatttcaaggagccactattgggctccttccctataggatgttgggccaggcaacagaacaaacctcctgaggcacttctacctgggaatgccctcctgaggccaatggcagccctctgatgaagatactatagtatttattttttgtacacgctggtgatcatccagtgtacatctctgcttagtgaaccttcatgaactggaggctgaatattctcatcctgcattgatagaaccacgtaggctggttctaggctgttttctgtgcaacactcaacatgacaataataatgatgatgatgctaatgatgattgtaaaatccgcagtagttgccatttattgccctatttggcttgtaagacttggcagatcacagtgacatacacacacacacactctctctctctctctctctctactgtgtgccagggactggacaaagcactttgcatgcattataacacttttcctaacaatcctgcagcaggcagcagtagcatccccgctttataact

SEQ ID NO: 461716 - DNA, 905 bp, Homo sapiens
caagggaggaaactgactgccttcttggggttttcttaactgtgctttttctgctctgcaggaaagatgcaacctgggccagaggcccctggaggttgtgcctgaacccagacagatcacacaaacctgagcagccattagctgctgtgtgggctcctttgcactgtggggctgctcctggggatatttacgttgtgaactggtaaaatctgaactgcagaatatcagtttccagacattcttcctagatgatgccgtctgccacggcagggacctctatcacccaaagggaaacagccgtctatctacgaagctgtgatctcccctacaagcaagagaactcaattgccaggaggtctttgctttttctggcttccagagaatgcagaaatttcaaggagccactattgggctccttccctataggatgttgggccaggcaacagaacaaacctcctgaggcacttctacctgggaatgccctcctgaggccaatggcagccctctgatgaagatactatagtatttattttttgtacacgctggtgatcatccagtgtacatctctgcttagtgaaccttcatgaactggaggctgaatattctcatcctgcattgatagaaccacgtaggctggttctaggctgttttctgtgcaacactcaacatgacaataataatgatgatgatgctaatgatgattgtaaaatccgcagtagttgccatttattgccctatttggcttgtaagacttggcagatcacagtgacatacacacacacacactctctctctctctctctctctactgtgtgccagggactggacaaagcactttgcatgcattataacacttttcctaacaatcctgcagcaggcagcagtagcatccccgctttataact

SEQ ID NO: 461717 - DNA, 4236 bp, Homo sapiens
  misc_feature (1)..(1): n is a, c, g, or t
  misc_feature (5)..(5): n is a, c, g, or t
  misc_feature (9)..(16): n is a, c, g, or t
ncctntccnnnnnnnnggagtctggaatggaaactgactttggggagcctgagtggggcaatgactccccagcagctgggggttcactcttcctctcatgctcttgatggagctggtggtctgggggtcttactccttggaggccgtgtggaccataaggtccaccaccctgttgctgctgccaaattcatcccaggaaaggagcctgacaaagtggccattgaagaccatggagttgaggccagtgaagagatcattgatgatgacagtgtccattttgccgagttgaaagctgccctggtgaccaggtatccaatatggccaaatccattgactcagactctcaccattgtatcctggatgaggctgacactgcatgagcagatggagctgtttgctagctctgaaggacagatgtcttcccccgagaggcagctgctctcagatgaggagctaacctacgaatgcatcagatgtcccaataaagtctccctggagctggaaagtggcattactgaaacattccagaaacgagctgaagtcactcaaggaaggccttgggaactagggtttggcccggtgggcagcgcatggtagacattcacacgcgctccagcactgaacactgcgacctggcagggagctcacagtattgtgggagaaatgaagaagtaaatagttaattttaagataatgtagtggctgtgagatggaagttttcagggtgttaacagggatgggggacctaaccagtggctgaggaggaagacaggcaggggtgagaagtattgggaaaggcttccagaaagagttaatgccttcaagtctatttcttcctatcatccgtgagggggatatgtgggagaaaagttaggaattcacaaaccccaccatgcatccgatgagaaggaaaaaattttccttccaattttctatgcgatgctattattcctagggtcctcatgacttatattagtgaacatttttttgcctctcattttgaacatgaattcaatgaaagttaattaaaatgatgtaaaatgtgaccttgtgtgaattaattaatgttagtaaaaatgagcctttttccccctttttttttttcaattactcacatatggaaacccaagaaaacatttgccatcacttgactaagcactgtcaggactcatggttttcaacatctttctcctgcttacaaccataagaacaggcaggtggccaatgaggggaggagggtaaaagcgagaatttgttacgctggaattcagcagagcctctctctaacatgtggggtttaagattagtggaatcatgagtaagagaagtgggaaagagtataaactaagaatctacttagaaagctgactgagccactaagaaaggggttgtggtagtcagaaactctttctctgctcttctcaaagaacatggaacaaaatatcagttgagtcatttggaatgcatttggctgcaagtaatagaaaccctaattcatcataattggaacaattagatggtttgttatctcacataagaagaagtccggggggatggcagttccagggttgattaattcaccagctcaccagtgtcttaaagatccaggttatttcgatgtttctaccctgccatccccagtgttctggtttatcctcataggctgctgtcttaatggacccaaggtgctttggttccaggaacaacacacagagcccaagtccagaggcagaaaagcaaacatttttatcttgtggctttttctttttttttccaagagaaaccttcccagaagccccatcagcagatttccttttttagctccattggcccaattgcgtcacatgcctgaaccaattgtttagcaggggaaatcactccgtcctctctagcttcaaccatgaactctcagtcctgggtaagagggcagcctagccttccctaaaggacttggtaacttggaataagatgaacaaaatcagagttctatgaacaacgaagttgggggatggcagaggggacagcgactaacacgtccatgttaaacaagagttctctgctttctcttcttgaacttgaggggcacagccttggggatttgggggatgcccctttgatcatctcatttcttctccttggtagcaagtaattgatagaatcacaccagaaaaaagagcaaaatatgacaaagaaacaactttaatacagtgaggatactggggaacagaccagatgtgagcagacagggaagtctttagcaaaactgtggagtgcccaaagcttggcttctgatgcgtggagcctttccgttttgtgttcttcctcctcactccacatcccacccaagaaacctggtattttaatattctcctctttgctccattaaagcatcaaacatattcacacaaggtttacgtgaccaaggagtgcaagatagggattaaaaaatagacttgaaataccagctctgccatctgctaactttctgaccattttgggcctcaagttcctcaccaacaaagtgagaataatgatactacccagcaggttgttaccgctatgtttattagtgttcatcctattggagcaagctgactgctaacaactttaaaatcatgatggcttaacacaagtttgtttctcactaacacagagtctagtgtcgatggtcctgatcgggtggctttctggtgacctgaggactcaaggatactgcccttgcattttaaggtgccactgtcttcaacacaggatctttaggttttctctctgccacattattattatggctgttgctgttattgtaactaatcctgtgtattgaaacggcagtcattttccagatgtaactacggtaccctaacagttcactgatgttcatggccataattccaggaagccatttctgagagcttatgtaccttaaatcccagtttgaggtgtctagggaagagacaatagtccattaaggatgacagcagggaagtctagtaacttctctcctctccacgatacttagcatggtgttggacacagcaggtgctgacccagtgactgtggcacttactcatggtggatgcactactctatttccttgggtccctttcccattttcacaccccttggctccacgtttgcttttactctcggtatccagaacccatgcttctttgtgagagggctgccctcatgcttctggagtctcctttacctgtgtgcagagagagtgggggatacctagaaacatgcatccctctgagatggcccttgaccaatggagggaggggctctcagtctccaaatctcctctgtgggaggagccagtgccctgcaagcacgggaccttgcttgacattgcactcttgcttggcttccttctcactgtcttgcatcctcacttccctgcaggggacactgcccaacacatcactttctcacaaatctgcatctctgggatgcttctggggaaccagcctgagacaggaggtaagctgaagaagcagaattttgaagattctgggctctgtttgaatggaatagctgagacgggtctttgagaacatcagtatttgcctcccacctcagtttttacattcacaaattaaaggatcacacaggcagactttggtatgatatgcagttcctgagcagtgttgggactcaaagacgtttatggcagctcatcagcctgcatccagtgcttcaaagggttctaagagactggctcagccaactgccagcctggtcatttcgaaactgaaatgaaagcagcagagagagttatatttatcaactgagtgagacttgcttttctcaacaggatatttacgttgtgaactggtaaaatctgaactgcagaatatcagtttccagacattcttcctagatgatgccgtctgccacgggtgagtgttttcagctttatgctgactatgtattaatataaagccattccttactcttctaccttaatatatagtctccttggttttaattaggtctctccttgcttctgaacttctggttttccccagtaatgtttaggaatgacctcagaccaggtacatacaaggtacaacgtggtatgtacaaggctgtacctcaagccacgtgagaggctaccttggccttgggcactatggtgaacactgtaaagtgccacgtagatcccctcaataaggacttgcagtcccagtggtgcagagtgctgctggcacacagaggttgcctgggctg

SEQ ID NO: 461718 - DNA, 1319 bp, Homo sapiens
tcatcctgtcctcacaatggctggtgtggagacccacagacttcatccttaggacggaccttcaggcacccaggctgcctactgacctccctggcatgggtgggaaccgggagctcgttggtaagcaggaggattcaggactatcgactgaaccccacctcctctgtggcacgcaccgtgctgtgtctttgcagtcatcatctcatcacctctgcaaaggaagattatctcccccattttgtgatgaggaaatggaggctccaggtggaaagatgcaacctgggccagaggcccctggaggttgtgcctgaacccagacagatcacacaaacctgagcagccattagctgctgtgtgggctcctttgcactgtggggctgctcctggggatatttacgttgtgaactggtaaaatctgaactgcagaatatcagtttccagacattcttcctagatgatgccgtctgccacggagaccatgtagatggattgaatggggatatgatgaggatgaccacccctgcatttgctaagttcttgggagtggcatcgatctcagccattccactggaatagggtcaggaaacaaaacgtgagggctctaccagctgctcagtctatcctttccaattgagcacactggaactgaggaagcaaagacagggtgagccctaacaccctcatcatcactgctgagcctgccttgacaagaactccatttatcacccgcctccataatagcccattctaactagctgtcatcgtggcatttcaggttctgctgatgtcattataatggaccttaactagtgggctgaaggcaatgaggggatgtgaggatgcatcttgtgaaggacaaaagtcatcctgtaaggattcatgagacctgagcagccagccagccctgaaatggttggaacaggagaaagaagaagagctcgacagataccctgcctgggctggcagctagctgcaccacaagctggccagctgacagcgggcacatcccttcatcacccagtgcctttcttccctcttgtgaaaatggagatatgctgagaaggttacttcagctcatccagagaaagcttcttcagctaactaggctgtagaaagggcctacagcctaaattttcaaaaacaagttaatgccagaatataaactccgtgaagtaacagattgtgtcggtttcattcctgcatgtatccctggtgcctagacagtgtctggcacacagtaggtgctcaacattgactgaatgtgagggaaaaacctatgtagttcaatactatgtagacaagatcataaatgatcacta

SEQ ID NO: 461719 - DNA, 614 bp, Homo sapiens
gagcctgcaacttcactccagagaaaaaccctttacaataagatactttatcagtttccttaagagcgggaggcttgtggtgaacatataatcatctgaaaggtgttaatgctcaaatcaggtgtatgggtggaaggaaattttccaaaaaaggaaaaaaaataaagatggggatgagttatgctgggtgaaagaagtcagtcaaaggtatacaggattccacctatgtgacattctagaaaaggcaaagctatagggagagagaacagattagtggttgccagaggttagtcgggggggggtgtggctatacagggagatttttgggggtggatggaacagctttgtatcctgattgtggtgagggctgcacaaatttatacgagttaaaattcatagaactgtaccatcctccaaaagaagtcaattttactgtataataattttaaaaacaagtatacattttttttaaagatggagaggctaacaaactttgcaacctttccaggtaaggattcatgagacctgagcagccagccagccctgaaatggttggaacaggagaaagaagaagagctcgacagataccctgcctgggctggcagctagctgca

SEQ ID NO: 461720 - DNA, 4751 bp, Homo sapiens
  misc_feature (1)..(1): n is a, c, g, or t
  misc_feature (5)..(5): n is a, c, g, or t
  misc_feature (9)..(16): n is a, c, g, or t
ncctntccnnnnnnnnggagtctggaatggaaactgactttggggagcctgagtggggcaatgactccccagcagctgggggttcactcttcctctcatgctcttgatggagctggtggtctgggggtcttactccttggaggccgtgtggaccataaggtccaccaccctgttgctgctgccaaattcatcccaggaaaggagcctgacaaagtggccattgaagaccatggagttgaggccagtgaagagatcattgatgatgacagtgtccattttgccgagttgaaagctgccctggtgaccaggtatccaatatggccaaatccattgactcagactctcaccattgtatcctggatgaggctgacactgcatgagcagatggagctgtttgctagctctgaaggacagatgtcttcccccgagaggcagctgctctcagatgaggagctaacctacgaatgcatcagatgtcccaataaagtctccctggagctggaaagtggcattactgaaacattccagaaacgagctgaagtcactcaaggaaggccttgggaactagggtttggcccggtgggcagcgcatggtagacattcacacgcgctccagcactgaacactgcgacctggcagggagctcacagtattgtgggagaaatgaagaagtaaatagttaattttaagataatgtagtggctgtgagatggaagttttcagggtgttaacagggatgggggacctaaccagtggctgaggaggaagacaggcaggggtgagaagtattgggaaaggcttccagaaagagttaatgccttcaagtctatttcttcctatcatccgtgagggggatatgtgggagaaaagttaggaattcacaaaccccaccatgcatccgatgagaaggaaaaaattttccttccaattttctatgcgatgctattattcctagggtcctcatgacttatattagtgaacatttttttgcctctcattttgaacatgaattcaatgaaagttaattaaaatgatgtaaaatgtgaccttgtgtgaattaattaatgttagtaaaaatgagcctttttccccctttttttttttcaattactcacatatggaaacccaagaaaacatttgccatcacttgactaagcactgtcaggactcatggttttcaacatctttctcctgcttacaaccataagaacaggcaggtggccaatgaggggaggagggtaaaagcgagaatttgttacgctggaattcagcagagcctctctctaacatgtggggtttaagattagtggaatcatgagtaagagaagtgggaaagagtataaactaagaatctacttagaaagctgactgagccactaagaaaggggttgtggtagtcagaaactctttctctgctcttctcaaagaacatggaacaaaatatcagttgagtcatttggaatgcatttggctgcaagtaatagaaaccctaattcatcataattggaacaattagatggtttgttatctcacataagaagaagtccggggggatggcagttccagggttgattaattcaccagctcaccagtgtcttaaagatccaggttatttcgatgtttctaccctgccatccccagtgttctggtttatcctcataggctgctgtcttaatggacccaaggtgctttggttccaggaacaacacacagagcccaagtccagaggcagaaaagcaaacatttttatcttgtggctttttctttttttttccaagagaaaccttcccagaagccccatcagcagatttccttttttagctccattggcccaattgcgtcacatgcctgaaccaattgtttagcaggggaaatcactccgtcctctctagcttcaaccatgaactctcagtcctgggtaagagggcagcctagccttccctaaaggacttggtaacttggaataagatgaacaaaatcagagttctatgaacaacgaagttgggggatggcagaggggacagcgactaacacgtccatgttaaacaagagttctctgctttctcttcttgaacttgaggggcacagccttggggatttgggggatgcccctttgatcatctcatttcttctccttggtagcaagtaattgatagaatcacaccagaaaaaagagcaaaatatgacaaagaaacaactttaatacagtgaggatactggggaacagaccagatgtgagcagacagggaagtctttagcaaaactgtggagtgcccaaagcttggcttctgatgcgtggagcctttccgttttgtgttcttcctcctcactccacatcccacccaagaaacctggtattttaatattctcctctttgctccattaaagcatcaaacatattcacacaaggtttacgtgaccaaggagtgcaagatagggattaaaaaatagacttgaaataccagctctgccatctgctaactttctgaccattttgggcctcaagttcctcaccaacaaagtgagaataatgatactacccagcaggttgttaccgctatgtttattagtgttcatcctattggagcaagctgactgctaacaactttaaaatcatgatggcttaacacaagtttgtttctcactaacacagagtctagtgtcgatggtcctgatcgggtggctttctggtgacctgaggactcaaggatactgcccttgcattttaaggtgccactgtcttcaacacaggatctttaggttttctctctgccacattattattatggctgttgctgttattgtaactaatcctgtgtattgaaacggcagtcattttccagatgtaactacggtaccctaacagttcactgatgttcatggccataattccaggaagccatttctgagagcttatgtaccttaaatcccagtttgaggtgtctagggaagagacaatagtccattaaggatgacagcagggaagtctagtaacttctctcctctccacgatacttagcatggtgttggacacagcaggtgctgacccagtgactgtggcacttactcatggtggatgcactactctatttccttgggtccctttcccattttcacaccccttggctccacgtttgcttttactctcggtatccagaacccatgcttctttgtgagagggctgccctcatgcttctggagtctcctttacctgtgtgcagagagagtgggggatacctagaaacatgcatccctctgagatggcccttgaccaatggagggaggggctctcagtctccaaatctcctctgtgggaggagccagtgccctgcaagcacgggaccttgcttgacattgcactcttgcttggcttccttctcactgtcttgcatcctcacttccctgcaggggacactgcccaacacatcactttctcacaaatctgcatctctgggatgcttctggggaaccagcctgagacaggaggtaagctgaagaagcagaattttgaagattctgggctctgtttgaatggaatagctgagacgggtctttgagaacatcagtatttgcctcccacctcagtttttacattcacaaattaaaggatcacacaggcagactttggtatgatatgcagttcctgagcagtgttgggactcaaagacgtttatggcagctcatcagcctgcatccagtgcttcaaagggttctaagagactggctcagccaactgccagcctggtcatttcgaaactgaaatgaaagcagcagagagagttatatttatcaactgagtgagacttgcttttctcaacaggatatttacgttgtgaactggtaaaatctgaactgcagaatatcagtttccagacattcttcctagatgatgccgtctgccacggagaccatgtagatggattgaatggggatatgatgaggatgaccacccctgcatttgctaagttcttgggagtggcatcgatctcagccattccactggaatagggtcaggaaacaaaacgtgagggctctaccagctgctcagtctatcctttccaattgagcacactggaactgaggaagcaaagacagggtgagccctaacaccctcatcatcactgctgagcctgccttgacaagaactccatttatcacccgcctccataatagcccattctaactagctgtcatcgtggcatttcaggttctgctgatgtcattataatggaccttaactagtgggctgaaggcaatgaggggatgtgaggatgcatcttgtgaaggacaaaagtcatcctgtaaggattcatgagacctgagcagccagccagccctgaaatggttggaacaggagaaagaagaagagctcgacagataccctgcctgggctggcagctagctgcaccacaagctggccagctgacagcgggcacatcccttcatcacccagtgcctttcttccctcttgtgaaaatggagatatgctgagaaggttacttcagctcatccagagaaagcttcttcagctaactaggctgtagaaagggcctacagcctaaattttcaaaaacaagttaatgccagaatataaactccgtgaagtaacagattgtgtcggtttcattcctgcatgtatccctggtgcctagacagtgtctggcacacagtaggtgctcaacattgactgaatgtgagggaaaaacctatgtagttcaatactatgtagacaagatcataaatgatcacta

SEQ ID NO: 461721 - DNA, 2103 bp, Homo sapiens
tcatcctgtcctcacaatggctggtgtggagacccacagacttcatccttaggacggaccttcaggcacccaggctgcctactgacctccctggcatgggtgggaaccgggagctcgttggtaagcaggaggattcaggactatcgactgaaccccacctcctctgtggcacgcaccgtgctgtgtctttgcagtcatcatctcatcacctctgcaaaggaagattatctcccccattttgtgatgaggaaatggaggctccaggtggaaagatgcaacctgggccagaggcccctggaggttgtgcctgaacccagacagatcacacaaacctgagcagccattagctgctgtgtgggctcctttgcactgtggggctgctcctggggatatttacgttgtgaactggtaaaatctgaactgcagaatatcagtttccagacattcttcctagatgatgccgtctgccacgggtcccttcctctctccagctgtctggaatggagctaccctgtctggtgcccaagcagccagctctgacccagagttaacatattatggattgtggagccacaggatggagtagcctgggtctgatggttctgttagtcaaggctagtcaaagaagcaggaccaacaggaaatacatatgtttatgtatgtatatgttatgtatatgctatgtatacacatacacacacacacagatacacagagagagagagagttaagaaagtggatcatgtgattgtggggctggcaagttcaaaatctgcagacccacagaagagctgatgttgcagctcaagtctgaaggcaatttggaggcagaattcccacttcttcaggggacctcagtcttttctcttaaagccttttactgattgaatgaggcccacccacattatgaagggtcatttgctttactcaaagtttactgatttaaatgttaatcacataaaaaaaaccttcacatcaatgctggtgggtgattgaaggtgggttattatgacaaatgcaatgaaataataaatgtggaagggcttctcacagtgcctgcctcagagtggaaactcaataaatactagggcattctgtgtctgaaaatctcacctctaattattctcttttccttccctattatacaaaacagcagcagcagtaacagcgaccacaaaatgcactccaagatacttctaaccatttcttgctgggggaatgtttgcatccttggttagttaaaacttttgtgttcctcccatgtcagaagcccctggatcttgtgtgaagctgtgcattccctgattagtttgtttctgtccttctgtggcttgttctaaagggctttgctgctgccttcatctggggaaattcacacactaatgcagtggtatctcatcccaatctattaggtgtgacaactactggcaagaaatagatttgtgtttaattctttgttgcccagcagggacctctatcacccaaagggaaacagccgtctatctacgaagctgtgatctcccctacaagcaagagaactcaattgccaggaggtctttgctttttctggcttccagagaatgcagaaatttcaaggagccactattgggctccttccctataggatgttgggccaggcaacagaacaaacctcctgaggcacttctacctgggaatgccctcctgaggccaatggcagccctctgatgaagatactatagtatttattttttgtacacgctggtgatcatccagtgtacatctctgcttagtgaaccttcatgaactggaggctgaatattctcatcctgcattgatagaaccacgtaggctggttctaggctgttttctgtgcaacactcaacatgacaataataatgatgatgatgctaatgatgattgtaaaatccgcagtagttgccatttattgccctatttggcttgtaagacttggcagatcacagtgacatacacacacacacactctctctctctctctctctctactgtgtgccagggactggacaaagcactttgcatgcattataacacttttcctaacaatcctgcagcaggcagcagtagcatccccgctttataact

SEQ ID NO: 461722 - DNA, 1112 bp, Homo sapiens
tgcgcggtcgggcataccggcttcgcttggcgcggcttggctggttggcttcgcttgttactggctctgactttggaaactgcgaagtttcctggttggaggtggtggctgaccagagtggcttggtcttactgggcctctgaggctgtgataggcggactggtgctgaggtgtctctgatagcctccgccatgaggaggagctctggcttcgggggccagaagggccaggggccctcctgctccttcaccggctgttggtgttgcaggggggacgatgtcgccgagagcgatgacagccccttcgcccagtgcgggtacaatatccaagagaaacacctcggcaagctccacagagctgccagccggggtgaagtctccaaggtggagtgcatcctttcgagcgggagcgctgacttggatgagagagacaagaagaaaaggactgctctgcatttggcctgtgccaacggccatccagaagtggtagctcttctggtggacagaggatgtcaacttgatgtctttgacaacaaaaacaggactgctctgctaaaggcggtacaatgccaggaagaggaatgtgcgactattttgctagaacacggagccgacccagaccttccagatgtctatggcaatactaccttacactatgccatctacaatgaggatatcccaatgacaaaaaaactgcttttacaccatgccaatattgaatcagcaaacaaggcttgtagggtccagccccacagggtcggtgggttttctccccgtgtgcggagacgagagagtgtagaaataaagacacaagacaaacagataaaagacagctgggcccgggggaccactaccaccaagatgcggagaccggtagtggcccagaatgccaggctgcgctgatatttattggatacaagacaaaggggcaggatattcagttgtcctagcatcagttgttgaaaacattgttctttctccactgaatgattttggtacccttagagaaaatcaattgatcatagatgtatgggtttatttctggactctcaattctattccttttatatttattctatccttatatcaatatcacatacttttgattgctat

SEQ ID NO: 461723 - DNA, 1193 bp, Homo sapiens
atcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaagcaactgttaattctgttggtaccaagcctcccgacagcctattgagtacacagtcgatatttgttactgaatgaacatgggtgcatttggagttcagctccgtaataactggtgtttgccatcacaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagtttggttttttttttttcacgttagactttattttcaattactcaattcccatcttcgtgtgctctgacatacacaatcaggataatgggattaatctggtggactacgttgttaagtattacctgcgttactatgatcagcgcgcgcacgagcgtgcacacacacacacgcaatcaaaaccaggactgaatctgataaagttttggaaaatggaaagagatactatgcctgagttcttccagcatagattagcatggagctttgtagtgaggatcttagatgttgttccatcttggcactcagatgagagtactgcttccattttaaagtagtaaaataagtatatgaagatgggggaaaaaagtacattgtgtctg

SEQ ID NO: 461724 - DNA, 734 bp, Homo sapiens
atcatcaaattgttggatggaaaacgatctcaaactgtgggaatcttgatatctagtttacatttagaaatgaaggatatccaacaggccattttcaatgtggatgactccgtggttgatctggagaccctggcagccttatatgaaaacagagcccaagaggatgagctggttaaaataagaaagtattacgagacatccaaagaagaagaactgaagctgctggataaacctgagcaatttttacatgagttagcccagattcctaattttgctgaacgtgcccagtgcataatcttcagatctgtcttttctgagggtatcacctccttgcacagaaaggtagagatcatcacgcgagcttctaaggacttgctgcacgtgaagagcgtgaaggatattttagctctcatcttggcttttggaaattatatgaatggaggaaataggactcggggacaagccgatggatatagcttagaaattctgcccaaactcaaggatgtcaaaagtcgggtatttatttttcataataagttcccatgatctgccattattttctttctttacctttaattttaaaaaacgtattccagattgttccatttatctctatcctccccttaacaacatttatattagagcatgcatttttttgtttgctttcttttcactttcgaataaagagttaccgagagccctttcttttctcttttaatgggcggcacgtgtga

SEQ ID NO: 461725 - DNA, 775 bp, Homo sapiens
aaatgtgtgaatgtggcagtgaatgtgtgcgaccctcctggatactccagctcactctggctctgtctcccccacttcagatgacagtgctgcagcccccaaaaccccctggggcatcaacatcatcaagaaaaataagaaggctgccccaagggcatttggggtcaggctggaggagtgccagccagccacggagaaccaggtgggtctctgccacacgccagagcaggcccggcagggggagaccaaggcacagaggcatgtccccttaatcgtggctgcacgctgtcacattgtggaggcacgagggctggagtccacaggcttttaccgagtgcctggcaacaatgcagtggtgtccagcctacaggagcagctcaatcctgggcctggtgacatcaaccagcaggatgagcgctggcaagacctcaatgtgatcaacagcctgctcaagtccttcttccgaaagctgcccgagcctcttttcactgctgccatttgtcccggggacatctgttgaggcccccatccctccccccgattggaagtgctgcctttatcatataataaatatccacatggcccacttcccccctttctagccttaacattgctctgccttttctgccatgccagccggcttcagctgtgccatccattcaggatgtttcagtccctggtagggcagatcctcccgcgttactctttctttaaaaactattcctggctgtctttgtgcgttagctcatccagatgaatttcagaataggcttat

SEQ ID NO: 461726 - DNA, 567 bp, Homo sapiens
aaatgtgtgaatgtggcagtgaatgtgtgcgaccctcctggatactccagctcactctggctctgtctcccccacttcagatgacagtgctgcagcccccaaaaccccctggggcatcaacatcatcaagaaaaataagaaggctgccccaagggcatttggggtcaggctggaggagtgccagccagccacggagaaccaggtgggtctctgccacacgccagagcaggcccggcagggggagaccaaggcacagaggcatgtccccttaatcgtggctgcacgctgtcacattgtggaggcacgagggctggagtccacaggcttttaccgagtgcctggcaacaatgcagtggtgtccagcctacaggagcagctcaatcctgggcctggtgacatcaaccagcaggatgagcgctggcaagacctcaatgtgatcaacagcctgctcaagtccttcttccgaaagctgcccgagcctcttttcactgctgacaaatacaacgacttcatcgaggccaactgcattgaggacgtgcgtcgtggcttcggatctctagataacag

SEQ ID NO: 461727 - DNA, 2619 bp, Homo sapiens
gatcctcgtgaggtcttgggggtcccaccgccctgcgagccgcgcccgcgccccgccagacccggaactgcgtcgctaggccgggagagggaggcggcgccgcagagcctcgggtgcagtctgagaagtttgggagtgacttgaagagtgactggaagcaccccagacccgaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctttgagcttcagttcccaaatttgctacataagattgcaagacttgccaagaatcttgggatttatctttctatgccttgctgacacctaccttggccctcaaacaccacctcacaagaagccaggtgggaagttagggaatcaactccaaaacgctattccttcccaccccactcagctgggctagctgagtggcatccaggacgggggagtgggtgacctgcctcatcactgccacctaacgtccccctggggtggttcagaaagatgctagctctggtagggtccctccggcctcactagagggcgcccctattactctggagtcgacgcagagaatcaggtttcacagcactgcggagagtgtactaggctgtctccagcccagcgaagctcatgaggacgtgcgaccccggcgcggagaagccatgaaaattaatgggaaaaacagtttttaaaaaacaaaagaaaaaaaggtttatttacagatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacaggttagtggtgatacattttaagtctgggagagcggcctgcttgtgcagtgggtcgccgaggataagag

SEQ ID NO: 461728 - DNA, 2770 bp, Homo sapiens
gatcctcgtgaggtcttgggggtcccaccgccctgcgagccgcgcccgcgccccgccagacccggaactgcgtcgctaggccgggagagggaggcggcgccgcagagcctcgggtgcagtctgagaagtttgggagtgacttgaagagtgactggaagcaccccagacccgaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgcaggtagaagtacctgggccagtcctcactgggtcctggctctccagggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattcttttccgtggcgcctcggaggcgttcagctgcttcaagatgaagctgaacatctccttcccagccactggcctgccagaaactcattgaagtggacggatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaaccttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 461729 - DNA, 613 bp, Homo sapiens
  misc_feature (2)..(2): n is a, c, g, or t
  misc_feature (4)..(4): n is a, c, g, or t
  misc_feature (6)..(6): n is a, c, g, or t
  misc_feature (9)..(9): n is a, c, g, or t
  misc_feature (12)..(15): n is a, c, g, or t
  misc_feature (17)..(17): n is a, c, g, or t
tnananacnaannnnangggactccagacatggaagagggttcctctggctaaagtaactggagaagaatccataaaggtgggggccaaggagccagatattaaagaagagaatgagcatcaggagctagggagagcacctagggagggggtggggaagaggggcacagcttgcccccatctggaggatttagcaaacccaagcaataaactcgggtctgtaaaactccattccctttctacaacacaagacactggagaccaaaacaattcaaaggaaaaagtgatgaggtgcactgagaaattcagggaatactccaaagctgcagaggatataaagaataggatttcccagaagaagagacatttttatcccagtaatccacaataaaatggggtgtagagagatgtatccagagctgcacagctagtggacgtctgagcaggagccacatgcagaagagtctgactccagggcctcagcgtgtaatgccctacacctgctgcatgggtttacatttccagctgctttaaagttaagactatggatgtctgaacagctctttttccttagagcataaaactaaactaacctaatgtttttttttttttaa

SEQ ID NO: 461730 - DNA, 1816 bp, Homo sapiens
cctacatgttacagacagcagatgggacctttcacattcagcctctgattggtttctccccgacccggcccgcgccacagcggtgctgctggtggtctgctctgtggggccgtgttgagagagaagctctgagggagaggctttgcatgcgtgcctcggtgcacggtgccagcctggatccctgtggctgtggaatgggcgcttgctgtttgccaggctccatcctgagagccatgcttggtggactggctacttcaatccttgcaccaaccctcggaagtcaatatggtggctgtccccactttacagatggggacacaggcttggaaatgccacatcacttgtgtcgcacgactagtgatgggggcggccctcccgaggaagcactggaagacagcagtggtcagagcccggtcagcagtgaaggtcagcgccattgccggcctccgaccctagtggcagtgtctggaacagggattctgggtgtgttggaggctgactgtagggaagccctaccccagaggtcccatgtggttggcccctggtgggatgtcttggcacctggaggcctggaagcccccgcgggtgggcagttggggccggtgttcctagaggaggccgtgctgccctgtggctatttgtgaaagagatttgcatctggtcactctgggagctggtctagttaagtactgggttccctttgctgagattttaagcagtaatcttttttctctctttctctttttgatgagtagagctctaggttaagaaatattaaaaggaatgtttttacatggaaaatgtttttttggttagcgttggctttcacttggtctaagtcagcaaatagctttcactcttaaactgtctgtcttcttgttctggtttttagagacacgtaatgactattttagcaaaatgcttacaaatctattttgtttttatgttttatgttttttacgttaacttaaaagtatttaacagacgttactccttcctgtatagaggtaggttaattggaaaacaaattgaaaacactattttttcatagtcatgtttactgtattttgtttgtgggggtagacactttgaagttcatgttaacccctgatgtgcccggccctcgagatatgtgtggaaggaaagtgtggttatggttttagaagcttgctttttctatacttttcatatcattcacatcttgtagggaggtatttatatttagacttaatatctgtaacttttttaaattctagaagtagtgattgttcctcacagaaaaattggaaaacagaaaaataaaataaaaattacccagagataaatgctagtaatatttcggtgtacctttgtcttttctcagtgcctgtttgcacacaactgatgtacgttctgcccattttcacattatctgtgagcatcctgcatgccttttaagactgcataatattcagtcatctggacatacacatttagcgacctatttcaatagtaatctgttgctgggatgtttatgttgtttgtttttctttttgctcaagctgagataaatctccttacacacaaacctttgactacatcgctgattgactgtatcctaacagcagactcctcccagtgggattagtgggtgaaaagctacagatgggaaaaaagctcatcacatcctgcctccttgctgtccagacagtggccccaggttacactcagctgaggacgaggccaccccctgcagctttatgagcatttgactcctgagaacattttaactgtagtccaagtaattaaataattattcaagctgtaatgtgcttgt

SEQ ID NO: 461731 - DNA, 3485 bp, Homo sapiens
gcggccgcgccctcgcacagatcccagctgggtcacccgcactgagtcaacagactgagcgcgtccaggcctgacagctctgcggctcgggccctgagagacagcgtctcgggctagagtgcagtggtgcgatcaaagttcactgcagccttgaacgtctggactctagggaccctgctgaatagctggggctacaggcgtgtgtcactgcgcccaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttgtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcaggtttgttttctgccctagacagtcattcaaatttgggtgtcatttcttatggtgtttccatgacgactttggaagacgtatttttaaagctagaagttgaagcagaaattgaccaagcagacttatattttctaaaacctggagacaaaccacataaatacaaaacaagtctgcttcttcaaaattctgctggtgagagtgtgtgaaggtctgtgaacgagtgttggcatggagcatggggttgaggggtggataaaggtctggattttaaaactatatttaagatagaactgttggattgtacatatcagaatcaagattacagaaaagtatccaacatattttctcttaatccttttgattttcatatgctaaaaaataaatggacaaatatctgttttgtgtaaacatcattttcatttctctgagataaatgcccaagagtgcaattgctgaattatacatgttaattttataagaaattgccaaattattttccaagatgagtgttccattttatgttatccctaccagcagtgtgtgaatgacaaaagtttgaattatccaaaataattgcatttgccttagcttatgtttttattcttgtattagaatttacatgtgtctcatgttctcataattcattgaacagaaaacttgccaattttgttcatttctcctcttcttaactaatctttatatttcatgcttcctttatctctgtggacagctctttcatataataccttcagttattaggagtagatatttttatagatgacaaaaatcaactaaataaaattgttaggtatttggatttatgaaatattttagaaatttcaaattaaatgagaacatgagataggaaaactatgatcatttgagtttaccattaacaaacttgtgacgtaaataacaccttagatttatatgctataccagtgtacacaaaaggctttgaacatttcaaaagctttcacttaagctgaaagccttatgtaaatccaaaggatacttggcaatttattagtgtttttatttatgaaaggttcatttttaaaactgagagaattctttttctgtgtaaacatgtcttcccatctgtttccacagtatttcaaaagtagtaatgttttggctatttattatttgtatagctgtaaccccaaccgccatgacaccttttgctttattttaatctcagtttcttggcagcactactgtattctgattcttaaaaattttgttgaaattgttacatctcagaaataatgagccaaattaaaggctaaatggaatttgtatttagtgtgagggggacttttattacctataagcctggaatgtaacctttttggttttgctgatgtaaaattaagagatctacaataatttactaatttatttgtgtgtttctaaagtgtctaaaattataataaattgtttttcattttttttagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggtaagttaacgttagttgtactcatgctatttatagatagaatgttatttaaaatctgttataaacatgacagttgacttattgcataatttggttattaatttgttaaagaaaatagagcaagtgtgtctggtatttaatacatgtaatcattttatatgataagtgacttttaaaaacaataacttaccaccattttaaaataatttcttgaaactaaagtgatctttcatgt

SEQ ID NO: 461732 - DNA, 351 bp, Homo sapiens
tctactcagaattatgatattggggtcactcactttatttcaggtatggagctttttgaggattgtatttgtactaggttactgaccaaatttagggatatagctgtcccgttttactaggggctgctatcataactaaattaatttgatgtatttacattttctaattatagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaa

SEQ ID NO: 461733 - DNA, 3366 bp, Homo sapiens
gcggccgcgccctcgcacagatcccagctgggtcacccgcactgagtcaacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttgtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcaggtttgttttctgccctagacagtcattcaaatttgggtgtcatttcttatggtgtttccatgacgactttggaagacgtatttttaaagctagaagttgaagcagaaattgaccaagcagacttatattttctaaaacctggagacaaaccacataaatacaaaacaagtctgcttcttcaaaattctgctggtgagagtgtgtgaaggtctgtgaacgagtgttggcatggagcatggggttgaggggtggataaaggtctggattttaaaactatatttaagatagaactgttggattgtacatatcagaatcaagattacagaaaagtatccaacatattttctcttaatccttttgattttcatatgctaaaaaataaatggacaaatatctgttttgtgtaaacatcattttcatttctctgagataaatgcccaagagtgcaattgctgaattatacatgttaattttataagaaattgccaaattattttccaagatgagtgttccattttatgttatccctaccagcagtgtgtgaatgacaaaagtttgaattatccaaaataattgcatttgccttagcttatgtttttattcttgtattagaatttacatgtgtctcatgttctcataattcattgaacagaaaacttgccaattttgttcatttctcctcttcttaactaatctttatatttcatgcttcctttatctctgtggacagctctttcatataataccttcagttattaggagtagatatttttatagatgacaaaaatcaactaaataaaattgttaggtatttggatttatgaaatattttagaaatttcaaattaaatgagaacatgagataggaaaactatgatcatttgagtttaccattaacaaacttgtgacgtaaataacaccttagatttatatgctataccagtgtacacaaaaggctttgaacatttcaaaagctttcacttaagctgaaagccttatgtaaatccaaaggatacttggcaatttattagtgtttttatttatgaaaggttcatttttaaaactgagagaattctttttctgtgtaaacatgtcttcccatctgtttccacagtatttcaaaagtagtaatgttttggctatttattatttgtatagctgtaaccccaaccgccatgacaccttttgctttattttaatctcagtttcttggcagcactactgtattctgattcttaaaaattttgttgaaattgttacatctcagaaataatgagccaaattaaaggctaaatggaatttgtatttagtgtgagggggacttttattacctataagcctggaatgtaacctttttggttttgctgatgtaaaattaagagatctacaataatttactaatttatttgtgtgtttctaaagtgtctaaaattataataaattgtttttcattttttttagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggtaagttaacgttagttgtactcatgctatttatagatagaatgttatttaaaatctgttataaacatgacagttgacttattgcataatttggttattaatttgttaaagaaaatagagcaagtgtgtctggtatttaatacatgtaatcattttatatgataagtgacttttaaaaacaataacttaccaccattttaaaataatttcttgaaactaaagtgatctttcatgt

SEQ ID NO: 461734 - DNA, 619 bp, Homo sapiens
atcatcatcacaccacattgctatgtgtaaagaccatagaaagaaaacattagaagctgtaaaacagaaccttgactgcctgaattcagaccttgaaaaggacctgcagaaactggatatggagaatcaggttctccttagaaagattaaagagaaagaagaaactatttcaagcctggaaagaaagctggccttgtcactagaagaagccaaagaggaggaggagttgaactatgtcatagatgaacaggaggaatccctgagggagctggaattagagacagcaaagctggagaaaagtaacgcaatcctaagcaggaatgtggtggaggttcagaaaaagatttcagggttatttacaaatattggccttgaagaagaaaccacaaagcagatcctggaggaaatgaaggcaagactacagaagtcaacagagtcctgtgcaaagcaagaggaggaactggccaaggcagaggcaatgtctcttccactgagggtctgcccgggatagaatgggagagaatcccaagggtcttagaaacagatctgcttgaggcataggagggggaggtacaaaaacatcttgcaaatgaatttctgattcttatgcattcttatg

SEQ ID NO: 461735 - DNA, 731 bp, Homo sapiens
cggagaaagggccctgggctcggctcccacgctcgggcaggcctcccgccgggggatcggagctgcggtcactcgcggcttcggggccgtggcgtcccgcgcacagcttccgcgcctctgcaaggcgctctgaagaaatggaggtgaacagaggaacagccactcccagcaagcaagggaagaagaatcttgaaagcctgtgacttcacagagacttcttgattgatgcccctgaaatcagcctgccaagtgtggcctctgcagcataaatacaaggagtctgatgacacaagacggcgtgcttgtccaactcctctggcaaggacccttcttggagggctgagattgttttcctggaggccaccagacttcaggcttctaacctcagagcctgggtgctttgtcttacagcatggtctttctgagctgctggagacctctcagaactgctcctatagccaaatccacatgataacagtggattgccaaatccacatgataacacctcctcaggtgccattttggttgattgagccaggtgcagaccccaggaatgggaatgaagaggaaaggccacatgaagacaaagtggccatctgcaagccaggaagagggccctcaccggagccagaacctgatcagaaccttgcaaacccattaagtaaaatgagcataatttctgcgtgaagcaggccagttcttgatctaaacttgtttctctgtgtcgtgac

SEQ ID NO: 461736 - DNA, 4646 bp, Homo sapiens
ggagaaggactacgtctttgacaaaaggctcagatacagtgtccgccagaatgaaagcaactgtcggtttcgagacatcgttgtgcggaaggaagaagggttcacgcacatcctgctgtccagtcagacctcggataacaatgccctgacacctgagggagctgaggatggtaactagcgtgcataaaaacttgactgcagcgcgcaatttgctcatcattttacatacattatcccatttgatctttatgaccgtgtaatgataccctctcatcttatggatgaagaccatggggagagggactcactgaactgatcgtggacacagacttagccaaggggcagacccagaatccaaacatcacatcttgggcttttccagctaaactttgttgtcatcagcatgtcatatttgttggccgcagatataattcactcagttaatatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcagggactttgtgaaggcctttatccagtttaagaagcctatcgtggtggccatcaatgggccggccctgggcctgggtgcctccatcctgcccctctgtgacatcgtgtgggccagtgagaaggcctggttccagacgccctacgccaccatccgcctcacgcctgctggctgctcctcctacaccttcccccagatcctgggcgtcgcgctgaagcaagtctggacaggggagagcactgatgacagctggcacgtaggaagcacttgctgtgtgctgggctgggctgtcaacgccgtccacgcccctgtgaggcaggacagctgtgatccccattttgcggatgtggagactgaggctagagaggtttaccccacctctccacaggccgggacacagccatggatggtccttgggctcactgatgccaatgagatgctgttctgtgggcggaagctcaccgcccaggaggcctgcagcagggggctggtgtcgcaggtcttctggcccaccacgttcagccaggaggtcatgctgcgggtcaaggagatggcatcctgcagtgccgtggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgattgtgcacacctggcctcagtctcctttccgacgcaaatctgtgtgactattagggcttggtcttaaaacccaattgagtgatttgcaaacccagatattgtacatttagaaatgttttgttaaatatatatttttaaaacaatgtaagtggaaattctgataatttatgtgtattatatgtaaagctagttttgcaaaaacaaactactagggaaatgttttttctttccttggacttgttttatttatttatttttgtttatatattgtgatgtctgttgttcacacagatactattttcatactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggatcctgtaaggacttcggacctgtcctacagggagttactatagggagacacctgcttttgcccaaatgcctgttgtcacagctctatctggatcttatctcctcctttgagaaagcaaatgtgagctttccaaaacccttagatgaccctggttcttacatattgtggcagacagtgtcttcactactgctaaattttcattagaaagagccccctcttttctgttgaacttctgattgggcgcagttatattcagcatcggttgaagtggggtcaggattctccttggacatggaaggggatgtttagaaattcctttagatcagtgtccaccttcattccctgcttgaaagaactagaaatgcttcagctttggatgtactatcaaatccaaacttctaaacatttcaaggatctctgaagattaaggtaggaatgtgaaaccatttctaaggtggaaatcttgctgttaagtcacaggtcctgggtgtaacgggggtggtgaaagtctgtattttggttgtttccatacagtcagttccaccaattgggtgaaagcaggtgaaatctttttgctgcagggtggactgaatttttcactttctgggtagttgttttgatcatgtgtaggcgaattccaggtaacttacagcaaatagatttgggatggaaaataccagacctctggttgtgtcagggtttatcctaatagctttcctgagacagagctcagactttcatttttgatcttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctttagtcagggacctttctagcaatccactccctcccatcctgttagccatgcagtggaactctccttccctctctgccccaaccccggtgatggctcactctcagcatcttatgggaccatctgagttaacaaccctgttccaagaagactttgtgcagaacttttgttagggtggtcataccttctcaccaccatttggaagacacagcctaatgctgatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgtagatatttaagggaaaccatttggggttgtcttgcatgtatatttttgttgtagataagtgttgcttagttatttctgcaaattttggttgaaatgcttacagactttaatacagtatatattttcaaaatataaacttttatatttctgtgataagttaggatatgcgttttaggcaatatttttcattaatatcacttgttcttttgaaaaatagcatactggtttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcag

SEQ ID NO: 461737 - DNA, 1130 bp, Homo sapiens
tgctctcccctgctttgtagctttgcatgtcttcttacatctctcacttcttggacttatgccatgcccacccctacctagaaaacagccactcctccaatactgaggttgccttttcttcctctagggctagcaaccacctcctcctttgcgacaggtatgacaggtgccccagacaggtgacctcgccagcactgcccaatgctggaagtctaattgtcggtaaacataccaccagtaacaaggtgcagctgagcgacactggcacccctcacaggctctcacagcccctgcaggggagagatgccaagaagacctgcacgttccctgccacacagaactgtttacttcatggaatggttttgacaggggaaactctgaaggaccacaggagttggaggttccacgtatctctaagtagtaacatacgatgggtccaaaacagaagaaagagaactcaagattcccgagccacagagctgttgattggaggctgactcagagaaaccctggattcagtgacatacagagacaacaggtacaggatcagtatgggttttaattgaggggctcggcaccaaatgacagacttgacacatccacccccaccatggatgctgtccgtccactgttgcacaatgtccttcagtgtctaatttacagatccagctgtatttccccttccacctgcatccctgaagttcctcccacctgaaaacttcacctgacccaagaaagcaaaggaaaaaacccggagagccagctcatggtctggttcactgtttaacagccagaagccagagcctgcgtactagaagtggatgcccaggaagtacttgtgagctgactaagaatgtaagaacgccacccacttcattcaggaaagtgaggcaggattccatggagtatgaatgactgcacatggaacaagcaggttatcatttatattcagcaagggacctccatgaacaggacatttggggagctgctatcaaacatcagaacttctgacactgtgcacacagtcttatattgtgccttgtctgttgtgatgtctcactacagtaatgattaagatgatgagcacttatgcgttgatattgcaatatgtctgtgtaagaactatcgct

SEQ ID NO: 461738 - DNA, 2648 bp, Homo sapiens
gggtcaccatccttgcagcacagcagaagtcacctctgccacggagaaggctgtgggtttgcatttctttggaatcacagtccagccagcacgttccccacttaaaagatttcataagctcacctttgagctgcgggaccctgccagggctgcagctcccatcctccccagacaaggcaagcctcagaatgaggcgacaacagcagctgtccaaatccttgggtgacagtaagaaccgccacaaaaagcccaaggaccccaagccaaaggtgaagaagcttaaatatcaccagtacattcccccagaccagaaggcagagaagtcccctccacctatggactcagcctacgctcggctgctccagcaacagcagctgttcctgcagctccaaatcctcagccagcagcagcagcagcagcaacaccgattcagctacctagggatgcaccaagctcagcttaaggaaccaaatgaacagatggtcagaaatccaaactcttcttcaacgccactgagcaatacccccttgtctcctgtcaaaaacagtttttctggacaaactggtgtctcttctttcaaaccaggcccactcccacctaacctggatgatctgaaggtctctgaattaagacaacagcttcgaattcggggcttgcctgtgtcaggcaccaaaacggctctcatggaccggcttcgacccttccaggactgctctggcaacccagtgccgaactttggggatataacgactgtcacttttcctgtcacacccaacacgctgcccaattaccagtcttcctcttctaccagtgccctgtccaacggcttctaccactttggcagcaccagctccagccccccgatctccccagcctcctctgacctgtcagtcgctgggtccctgccggacaccttcaatgatgcctccccctccttcggcctgcacccgtccccagtccacgtgtgcacggaggaaagtctcatgagcagcctgaatgggggctctgttccttctgagctggatgggctggactccgagaaggacaagatgctggtggagaagcagaaggtgatcaatgaactcacctggaaactccagcaagagcagaggcaggtggaggagctgaggatgcagcttcagaagcagaaaaggaataactgttcagagaagaagccgctgcctttcctggctgcctccatcaagcaggaagaggctgtctccagctgtccttttgcatcccaagtacctgtgaaaagacaaagcagcagctcagagtgtcacccaccggcttgtgaagctgctcaactccagcctcttggaaatgctcattgtgtggagtcctcagatcaaaccaatgtactttcttccacatttctcagcccccagtgttcccctcagcattcaccgctgggggctgtgaaaagcccacagcacatcagtttgcccccatcacccaacaaccctcactttctgccctcatcctccggggcccagggagaagggcacagggtctcctcgcccatcagcagccaggtgtgcactgcacagatccatgaattcaatgcctttcttcatattttacccatgcagatggctggtttacactcttctgataaggtggggccaaagttttcaattccatccccaactttttctaagtcaagttcagcaatttcagaggtaacacagcctccatcctatgaagatgccgtaaagcagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttct

SEQ ID NO: 461739 - DNA, 967 bp, Homo sapiens
gggaaacccttgtcccaaaagcccatgtgtacagcaaaagcaaatgacccggagtcagcagatggatgaactcctggacgtgcttattgaaagcggagaaatgccagcagacgctagagaggatcactcatgtcttcaaaaagtcccaaagatacccagatcttcccgaagtccaactgctgtcctcaccaagccctcggcttcctttgaacaagcctcttcaggcagccagatcccctttgatccctatgccaccgacagtgatgagcatcttgaagtcttattaaattcccagagccccctaggaaagatgagtgatgtcacccttctaaaaattgggagcgaagagcctcactttgatgggataatggatggattctctgggaaggctgcagaagacctcttcaatgcacatgagatcttgccaggccccctctctccaatgcagacacagttttcaccctcttctgtggacagcaatgggctgcagttaagcttcactgaatctccctgggaaaccatggagtggctggacctcactccgccaaattccacaccaggctttagcgccctcaccaccagcagccccagcatcttcaacatcgatttcctggatgtcactgatctcaatttgaattcttccatggaccttcacttgcagcagtggtagaatgcccaatgcaccagtgctatggaagaccaatggagttccatgggggaaagcacacagccatacatactttactgtccaaaaacagaagaagaagaagagaattaaaaagaagcaatgatttctgtgccaatgaacaagaacaaaagtcatttttagaaatacatatactgtaatatttaccaacagtcagtaactgttaatgatttcaacaatgcattaaaagaatgtgctttctcagattaaggatgccaaaaaagatatttcactgccttttcaaagaccagtatattttct

SEQ ID NO: 461740 - DNA, 1234 bp, Homo sapiens
  misc_feature (3)..(3): n is a, c, g, or t
  misc_feature (6)..(7): n is a, c, g, or t
  misc_feature (10)..(10): n is a, c, g, or t
ccncannagncagagcagttaagatgaaagggggcggatgaaaatgtcccggactgtgtcacccccagatcctactagaaataagaaaactccactgccaacatctatggtccccacaagtcctgggaggctctgctgcttggcagttcactcctcgggctctggcattggagactttggctggaatcgtggctgcgccctaacccagaacagagacagtaatacaggatgcgttcgggaccgaagcgaggtgatattcatgtattatggagcggtgtgctctcaatcaatccatgtcctgttattttcacaccaaaagcacctaacccctgcaattggtgtgcacgggggtgggcaccagttcttgtgctggctgaggtcattttcagaagggatggataactccttgcctccctggaagaaggcagagatgagtgttcagatctagaggtggctgtagtggaaacagagagccctgatccttcttgctcaacgcttcctgggccaatgtttgcaatcaaaatggccaatttccattcaaatgtcaattactatgggtgaggaaatcagcattacatcacagatgtgtgagcacctacacaaagcctgcaaatgctggacagggaacctcgtgcaaataatatggcagtattggcaggaatgatggaggaatccctttaaaatgtacacttcaggcagcagcagctaacagaaggcctgaccatcagaagggaaaatgcacatgcagatgaatgtgtggcagcactgggatcctccagatatccagttgattatgagaactatgactatctgcatagtcagagtcattctttggaatcagacagatgtgtatgggctggagtatgtacatattagggccataacaattctgaaaactggtgacgagaagccactcaccatttgctactaacagctcaaaggtgaagaatattccattaaataaagcactaaagaagataagcctctcctcaggcgacaaagggccaaccccaaatgaagtccatgctgcgggtcttaaggtcatctgctcataagaaactggtcacttctggtgtgagttaagatgaatggagagagaattggttcccagagaccacagtgaaaaaggttaagaacataataaagaccgtaagttccccaaatagtgaattgtgtttctcttcttcctaaatacagaaaggaagggtgctacttttcactctgagacagatgg

SEQ ID NO: 461741 - DNA, 1896 bp, Homo sapiens
  misc_feature (1)..(1): n is a, c, g, or t
  misc_feature (6)..(6): n is a, c, g, or t
  misc_feature (9)..(10): n is a, c, g, or t
  misc_feature (13)..(13): n is a, c, g, or t
nacatntannaantagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctgggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagagaacggtctggttctgtcacccaggttggaatgcagtgtcaggatcatagctccactgtgtgacctcaaactcttgggctcaagcaactctcctgcctcaagcaactctccagcctcagcctccgagtaactgagactacagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacgcccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactc

SEQ ID NO: 461742 - DNA, 981 bp, Homo sapiens
gccactgcactgggccaggaatatctttctatgacaaacggtctggttctgtcacccaggttggaatgcagtgtcaggatcatagctccactgtgtgacctcaaactcttgggctcaagcaactctcctgcctcaagcaactctccagcctcagcctccgagtaactgagactacagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacgcccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactc

SEQ ID NO: 461743 - DNA, 1436 bp, Homo sapiens
cagtatgctcatgggaacccagctggaaagtgctgtggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagagaacggtctggttctgtcacccaggttggaatgcagtgtcaggatcatagctccactgtgtgacctcaaactcttgggctcaagcaactctcctgcctcaagcaactctccagcctcagcctccgagtaactgagactacagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacgcccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactc

SEQ ID NO: 461744 - DNA, 4122 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgataatactttcgtgattttgtggtggagaaggcctttccaacacacaaatgtaggaaatcataaaggaaaactataaaacaaagaaatgtagtaaaatctcttcaacaaatagtgttgggaaaactggacatccacatacaaaagaatgaaattggattgttgccttaatgccatacatagaaatcaacttaaggccgggtgtggtggctcaagcctgtaatcccagcactttgggaggccgaggtggggcagatcatgaggtcaggagttcaagaccagcctggccaaacagtgaaaccctgtctctactgaaaaaaatacaaaaattagctgggtgtggtggtgggcgcctgtagtcccagctacttgggaggctgaggcaggagaattgcttgaacccgggagtcggaggttgcagtgagccaagatggagccactgcgctccagcctgggcgacacagtgagactctgtctccaaaaaaaaaaagaaatcaacttaaaatggattgaagatttaaaagtaaaatctgaaactatacaattctagcagaaaacataggggaaaagcttcgtaacattggtcttggcaatgatctcttggaatgcctaagtgtatgcccagccacgttatgagagaaatataaaacaattgacactttacttctatt

SEQ ID NO: 461745 - DNA, 757 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggtgagtgctgccacacaaccttgaggtccttttgcggtgacacaccttgtttcccctcagtgctttccttcaacccctgtcccatcgccacccgacgcctcccgaggtgtacacaaaatggtccacctccaggtgtcctaaaccctagaacctgtcagttgtctcctttgaaccgtcatctttcatcgttttctctttcgtatcttcttctatttgattctctttgtctattcc

SEQ ID NO: 461746 - DNA, 796 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtgagcaggttggatttgaaaattttcttgcaggtaggttataaacaaaggtgatctatttcaaaagattgcataaaacttgggatattttaattttaattcctgaatgttattctctttacttcaaaaattaaaatttctttttagatccaatgccatttaactcatttattcaaattttattttaatgtttaaagaaaatata

SEQ ID NO: 461747 - DNA, 3455 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgat

SEQ ID NO: 461748 - DNA, 2793 bp, Homo sapiens
atccccgaggtgtcatgaacaatcgacaatctaaggacaaatcatcaggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgat

SEQ ID NO: 461749 - DNA, 1849 bp, Homo sapiens
tgcggagtgtggggagtacggggcttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgat

SEQ ID NO: 461750 - DNA, 2715 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagatcaggtgtgagttgtgtgtgtgagcctttcgttctccctt

SEQ ID NO: 461751 - DNA, 466 bp, Homo sapiens
tactttgtgagcctctcctatgggagggagagcaagcctctgactgctcaacagacaaccaaactggatgctcccactaacctcgagtgcatctttagagcccctctcctaaaaaatacaaaaattagctgggtgtggtggtgggcgcctgtagtcccagctacttgggaggctgaggcaggagaattgcttgaacccgggagtcggaggttgcagtgagccaagatggagccactgcgctccagcctgggcgacacagtgagactctgtctccaaaaaaaaaaagaaatcaacttaaaatggattgaagatttaaaagtaaaatctgaaactatacaattctagcagaaaacataggggaaaagcttcgtaacattggtcttggcaatgatctcttggaatgcctaagtgtatgcccagccacgttatgagagaaatataaaacaattgacactttacttctatt

SEQ ID NO: 461752 - DNA, 3484 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagatagtagaagcttttggagaataagaaagggtggtggggagtgtggttggggtgggtggtgagggggggggggggtggtgtggggtggggttgggtgggtgggggtgtggggtgttttgtgttggggggttgggttgccgccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgat

SEQ ID NO: 461753 - DNA, 3371 bp, Homo sapiens
atcttgctctgcccccgacatcgtggtgagaggggaaccttcctcatatctgggcgctggcctctccgggcttgggagagaggaactcagtgatcatagagctggccgaatgccggggtagaggggaccggaagttgtttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccatttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgat

SEQ ID NO: 461754 - DNA, 1949 bp, Homo sapiens
tctataatatgaactcaattttgcaaaacttcaaagtacgtacaacttttaacttactagggtatacataccagtaataaattcacaacggtagacatgtttgcctactgtaaatataacaaagactaaacaagcagatactaaatcattaagcaattatcagttagtatctttaattttcttatacttctatattttctatagatcatctttgtaacaagaagaaaaccaaccaaatgaaaatgaaatgaattctctcaaaaagaattaagtcaagacaggaagaaggctcgcaaagtaatataaaatatatcttatggtttatgtaaaattcttaataaaataccttctttgctccaagctgcactctggctttgcctttgggtcaggtggcatttctttgcacgatgactggttttattgagtaggcactgcttcagccctacaggaagaacaaaacctctctggaacacagcagcattcctgactcccacttgaggaggcctaacaaaacggcatatgcctcaacagcagcagatcagtgttaaaaagtctggagtcaaggggaaaaagtaaaattggaccatttccaaaatctcacaaaaagcaacaaactgacgttctaagtgcccaacatgagcaaattagaaccttaaataaaggtcactcttaatgcctatcccagcatagatgcagcaccaagtacagtgtcattttactggtttacctttttcattcttgaaaacatttaccacattggcattatttgtgcatccatcaagaagtgctgaaaagcattcccctcacacactgcatgtgtcctgtgagtggatcttccattttacttgccagttctggaaaactttgaatttgtgtgtcgatggaaaattaaagtttagtggcatctttgccccacattcacccaacttttctaaggaactatttcaatgctacttttcactagtgtcacttttcagtcttagcctcctggagtacaactttattagaagcccgcaaagcactattgacaaactaaccttaaagaacacagcttgcaatgtggtccttgtgtatgtgactcgtttgcagctcacagcctctgcatctttccatcgagtctgacaaaacctgagttggtctgtaactgctcattgagacaagtcccctgatgtcacatacagatgctgggagaatgtcaagtttctatagaaatttctaaacatttaccctgaatttctatgtttctgtcattacatagagatgacagagtgttgacagactttgagtggtctttagtaaccaattgttgaaagtctggtttagctaaactagtttttttagttcaaacagatgttttcactcctaaaagactcaaaatttctgacaatgccctttattaatgttactttttgagaaatcacttattaagtaaaaattaaatttacatttttcaaaattgcatgttgggttaatttaccaaatcttttatctgttttgtgtttccagttagccatttttgtttctgatttgtaaatattcaaaaatatttgttgaaattacaaattttattaattgatttttgaggggagtagggtgcgttagttacttttcatttaaattctgtggtgtttttgcatattcaaattattgtattgtgaataacctgaaagacagtagctgtatgatcgtttgaggtaatggtaacaatactcaagggttgaaaagatatgattttaagtatgagctaaggagactgccctttatgtaactacgggatgatgtgaaaatctgttttaacagcatgattaaatttggaattcttttttttgaagttttgtaaaagggaggcagaagtttaagggaaaaagttggccaggtaaacttggatagttttagatctattagtgacagaatactcaagctcttgaaaataggaaaagttgttcttg

SEQ ID NO: 461755 - DNA, 462 bp, Homo sapiens
tgctatttcagctcaccaaggaaaagacaaactcctaaaagcttccagggagaaagtcatgcataaacaagtgaaactcaggatggcatgaggcttcgccaccacgactggttagaagacaacagcacagactttgaaattctaaggtaaaattatcctcaacctagaaatacgtaatcaagcaaactatcaatcaagtgtgagggtagaatatgagagacgtgaatactgatggggatgtgatatgcagcaggcactgttctaaatggtttacatgtaccaacccaattaagaaacttaaaatacacacgcgcacacacacacacacacacacacacacacacagtttttcctgctaatcattttacgatgaaacagccaagtagctaacccagagcccacaaaggcagagtaaaaattctaacacttggtaaaataaaaatgcacatataccctgtgatc

SEQ ID NO: 461756 - DNA, 1891 bp, Homo sapiens
tgctatttcagctcaccaaggaaaagacaaactcctaaaagcttccagggagaaagtcatgcataaacaagtgaaactcaggatggcatgaggcttcgccaccacgactggttagaagacaacagcacagactttgaaattctaagatcatctttgtaacaagaagaaaaccaaccaaatgaaaatgaaatgaattctctcaaaaagaattaagtcaagacaggaagaaggctcgcaaagtaatataaaatatatcttatggtttatgtaaaattcttaataaaataccttctttgctccaagctgcactctggctttgcctttgggtcaggtggcatttctttgcacgatgactggttttattgagtaggcactgcttcagccctacaggaagaacaaaacctctctggaacacagcagcattcctgactcccacttgaggaggcctaacaaaacggcatatgcctcaacagcagcagatcagtgttaaaaagtctggagtcaaggggaaaaagtaaaattggaccatttccaaaatctcacaaaaagcaacaaactgacgttctaagtgcccaacatgagcaaattagaaccttaaataaaggtcactcttaatgcctatcccagcatagatgcagcaccaagtacagtgtcattttactggtttacctttttcattcttgaaaacatttaccacattggcattatttgtgcatccatcaagaagtgctgaaaagcattcccctcacacactgcatgtgtcctgtgagtggatcttccattttacttgccagttctggaaaactttgaatttgtgtgtcgatggaaaattaaagtttagtggcatctttgccccacattcacccaacttttctaaggaactatttcaatgctacttttcactagtgtcacttttcagtcttagcctcctggagtacaactttattagaagcccgcaaagcactattgacaaactaaccttaaagaacacagcttgcaatgtggtccttgtgtatgtgactcgtttgcagctcacagcctctgcatctttccatcgagtctgacaaaacctgagttggtctgtaactgctcattgagacaagtcccctgatgtcacatacagatgctgggagaatgtcaagtttctatagaaatttctaaacatttaccctgaatttctatgtttctgtcattacatagagatgacagagtgttgacagactttgagtggtctttagtaaccaattgttgaaagtctggtttagctaaactagtttttttagttcaaacagatgttttcactcctaaaagactcaaaatttctgacaatgccctttattaatgttactttttgagaaatcacttattaagtaaaaattaaatttacatttttcaaaattgcatgttgggttaatttaccaaatcttttatctgttttgtgtttccagttagccatttttgtttctgatttgtaaatattcaaaaatatttgttgaaattacaaattttattaattgatttttgaggggagtagggtgcgttagttacttttcatttaaattctgtggtgtttttgcatattcaaattattgtattgtgaataacctgaaagacagtagctgtatgatcgtttgaggtaatggtaacaatactcaagggttgaaaagatatgattttaagtatgagctaaggagactgccctttatgtaactacgggatgatgtgaaaatctgttttaacagcatgattaaatttggaattcttttttttgaagttttgtaaaagggaggcagaagtttaagggaaaaagttggccaggtaaacttggatagttttagatctattagtgacagaatactcaagctcttgaaaataggaaaagttgttcttg

SEQ ID NO: 461757 - DNA, 1283 bp, Homo sapiens
tcaaatccctgcagggggagaccagcagccccgacttcagccgccatgcctcctgcctgagaagctagctgcgaaggttccagaaggagactgccctccgggaacagaaacagcgcatgactgcgacctgtctgcaaaaatcttgatcacttgtaaatccttctccacctgataagttatcacattggctcatgatgttttttttcattctcaccctatggcgtggatgctgttactaccccattttacaaaggagtaaagtgaggcccagagagaacagttaaatcacttccccagcttcactcaactcatctacggtgagtcgacggtacacatgcccttccacaacacaaaggtctccactttgccacgtgtcactctgatggttccaggtgcagattttgcgtctgcttcttgacttctaatggctgcaccattttgcattggatggttataccatcatttatttgactcatctcctgtgcacaagcatctagtttatctgcaaacttttgctaccaaaaacaatgctgcaatgaataaataagctgatgcctgcttctaagcgtgcgtgcatgctgtaatgtgagatgaattcccagaagtggagtggctgagtccaagagtaaatgcatttttcattttgatagtatcgccaaatgtctttccaaaggggttgtgctggatcccactccagctagcaatgtgtgagagcaccaatcccaccgcccactgcagcacacatattgacgtcggctagtccaataccagcacaggcagctgggccccctcgggtgatgcagtgggcaaagtgcgcactcagctctgagatcctggcttcctcacctgcggaaaggatgagactcgcccagcgttcacccagtgaatatgctttcagcctctgctgggtaccaggcatagttttgggcactgggaataaagggtatttgctccttttgattgattacctcatgttatataacctgagtggctacaagcagcaatctgtaatttgcaacatccggaaagccactgtcagcttcagaggctccaagagggcaagttacttgcccaaggtcacacagccggtgctgatggcgctggactcagacctgggcatcctggttttggagcccctcattcttacccaaggtgcttctgtgccaccccaggacagggtgtggttgcagagaggtccatgagcaggcatggccacccctgcaggcacagaacacaagtgttctctccaaatgatgggcgtcagagcccagccagccctgctc

SEQ ID NO: 461758 - DNA, 4740 bp, Homo sapiens
acagctaataaatggaaaccatacagctaataaatggaaacctttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagaagcatgctccattatacaattaaagaaaaagaagacctatgcaatgataagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaacatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 461759 - DNA, 4475 bp, Homo sapiens
acagctaataaatggaaaccatacagctaataaatggaaacctttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagaagcatgctccattatacaattaaagaaaaagaagacctatgcaatgataagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctgga

SEQ ID NO: 461760 - DNA, 4769 bp, Homo sapiens
acagctaataaatggaaaccatacagctaataaatggaaacctttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagaagcatgctccattatacaattaaagaaaaagaagacctatgcaatgataagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcggctggaataaatgtgagcttcatgcatggggggcgctcttcaatgatgagtccaggaactcgatggtcctgcagaacgcaatggatccgttatagatgctctaggtgcggcccgtctgtacaacgacactggtttcctggaactactctgagcagtatactcttctgcttgtcattcttgacggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaacatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 461761 - DNA, 4686 bp, Homo sapiens
acagctaataaatggaaaccatacagctaataaatggaaacctttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagaagcatgctccattatacaattaaagaaaaagaagacctatgcaatgataagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacacctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaacatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 461762 - DNA, 305 bp, Homo sapiens
gaaaaaaaaatgagaaagctgcctctattctacttcttttcaaagctgcccaactgttaatattttagactcggctccctatgcccagtaaatataaattttcagaactgtgatcacagccctggctaaatagtgcccctggtcaaaccttcgtaggcaaaatgttttctccagctttctgctagttcttagaagccagtgtgaaggaaaagggatgtcatgaagcatcactctccaagctgatcatctattccattgccttgagaattatgtagaataaaatcactgtctccctaaatgataaa

SEQ ID NO: 461763 - DNA, 2634 bp, Homo sapiens
agatcatatggccgcggcagccaaagtccacagggcaacaggctttgatgctgttctgcactaccgcaatgtctccctttagaactaaagtacacattccatatgacttcagcagaagtactgaccggaagacatcagccattctgtcactgtccaccctacagctggtacaacagcatcagaggttcagcagtgaccatgggatccactggagctaccacatgctacagtacccagagacttctgacctggcagtgctgtggactgtccttgtgaaggtgcaactctggtaccagcttgccgatgaaataggacacgggccattttatccaaagtctcatcagctaccacagcaacaaggtaaagggcacagaaagagctcagataggtgctacgtcactcagagttcaggtaacataactggaaatagctccagatatgtaagaagagagatttcacacaatggtgcttgcacaatctttggaagggctggaggaggagaagtcactttcttcaaggccttccgtgaaaatcagagacaccaacaggccagcatgctcccccttgcccctggaccttcccttctttttgtggacttcaagcatcagctgaagctcatggggcctgcctgcttatgataatctcttcctgatgcctgctctgtggaattcaggcttacctagccagacctcacaattgtgtgagctaatcttacataacaagtaaatccatatgtaagtttatataatgtaaacaaaatataaaatatacatatgtatacatacatatgtaagtgttaagatatatagatgtgatatattgagagagagagctcctaccagttctatgcctctgattgaaccccaactgatatagaatattctactctcactttcaactactcacaataaactcattatccttttcctcattctataccaaaaccaactccctttttcatataattcatgatacaatcttttccagaatttgaaaaaaaaagaaagacgtttctttcctctcatctgtagtatccagtaatccctaattccacacagttttcctttaaggtctctcccttctattccaaaccagttttcccttttctcacgctgtgatgattttccttcttcctaaagcttttccctgtctcaattctcaccctcttttaatgcagtctctatggaaagacctttttacatctccctacatactgctctatttaaaaatgatcatactattgcctacaagttaaaatcttcagttgtttttgtctgtttttaagatagcatttaaggcttaacaaaatattatttcataattaatatagaatagtagtcataatacaataagcaattctatgtaaggcactctgagaagtggttttcacaagttatcgtctttaattctcactataatcccatgagacacgtacaattatccccaatttataagtgacaacattgaggcagagagaggttaattcattccccaatttatacatccattagcagtattgatatagtccagggactcctagaaacacctgttgtgttgctttggtgagcagatgctgttcatcttccatggcacctgtattttatctgcatggagatgagctcagccagagtacttctcagagaggataccacgtggatgcaaataagagcagagaaagcaccgagtagttacaatggtccttgctgggtgtttggagaagctaattatttgagagagaaacaagcctaggaaagacttttgggattaggtgaaaagtgtacccttgcagggagcaagaagccatgccatgcccaggctttcgatcgctccaccacaggatatcattgtccacaggccctaactttagttcttgatttttccaacctctctttaaagtttattcttattttccaaaacttagaaaccatgcccaatggaatattggctgtgaaatgaatgaatgtgtgtctctgttagatcagccaggctgtttctcttaacacattcccccgacatgattctgagatacattaacatcacaatgctttcttgaccatcgagtcacacagaaatgaaaccagtctgaaaagatttactttccacaaggctatttaagttacgactacaatttttctagagtctcttctagttccaaagtacacatatatgagttatctttttcttttcaagacgaattttctggttatgctccattgtcatctttaagtaaaagccatctgatattttactgcaagcatgtggcagtgaagacgacaatgactgctagtatggtttgtgccactgccttgatttccgctcaggcaccagcagtcttacccaccattgctttggtgcagttggtggagatatcaatggatcaaaagcgcaagtaatatgactcggctccctatgcccagtaaatataaattttcagaactgtgatcacagccctggctaaatagtgcccctggtcaaaccttcgtaggcaaaatgttttctccagctttctgctagttcttagaagccagtgtgaaggaaaagggatgtcatgaagcatcactctccaagctgatcatctattccattgccttgagaattatgtagaataaaatcactgtctccctaaatgataaa

SEQ ID NO: 461764 - DNA, 958 bp, Homo sapiens
gaggcacagtaaaagttctcagttgattatcttgagctcaaggtgattgggtttggtacagtcaggtgactgggagggctgggaacccgcacgggtttaattgttggttatgttagaagcagacccatacaaaggggcccctattaaagggtctagactgagcaaaacgaaataccttcgtgctaaattttctgaacatcaggagtccaggtatagccagttgcttatctagcaaactccatccatcttctgaacagaacagtgttgtgttcaaggtctcgcgaggctgcaatcaaggtgtcagctgagctgtgttttcagctggatgtttgagtggggaagagtccacctccaagctcactcaggttgttcacagactgtatttccttgtggctgtataactaagaactctggcattttgctggctgttggctgaggctacccttcggttctagaggctgccttgtaaacttcttcaacacagctgctcacttcatcaagcctgcgacaagaacctctccagtgcatgccagcaagatggggccatacacagacataaaattacgggagtgacatcccatcacctttgcattttctattgctaagaggcaagtctcaggttccacctgcactcagatggagggaattacacaaaggcatggacatcaggaagcaggaatcactgtgggtcactctaggatttgttatccacaagggatcacattatctgcttagaatttcaaacgaataataaaaccaaaaaaagttggtctgccttttaaaaattttcccttatttaaaactttattcttaataaagaaaatgaaaacctaaaaaaaaaaaaaaaaaagtgtgggggggccggaaatttaaaaaggggggggcaggtagaaggtaaggtaaaacgggggagggggtcaaaacgggggcggtgaacagagggggtgtaaagagaagg

SEQ ID NO: 461765 - DNA, 2396 bp, Homo sapiens
gaggcacagtaaaagttctcagttgattatcttgagctcaaggtgattgggtttggtacagtcaggtgactgggagggctgggaacccgcacgggtttaattgttggttatgttagaagcagacccatacaaaggggcccctattaaagggtctagactgagcaaaacgaaataccttcgtgctaaattttctgaacatcaggagtccaggtatagccagttgcttatctagcaaactccatccatcttctgaacagaacagtgttgtgttcaaggtctcgcgaggctgcaatcaaggtgtcagctgagctgtgttttcagctggatgtttgagtggggaagagtccacctccaagctcactcaggttgttcacagactgtatttccttgtggctgtataactaagaactctggcattttgctggctgttggctgaggctacccttcggttctagaggctgccttgtaaacttcttcaacacagctgctcacttcatcaagcctgcgacaagaacctctccagtgcatgccagcaagatggggccatacacagacataaaattacgggagtgacatcccatcacctttgcattttctattgctaagaggcaagtctcaggttccacctgcactcagatggagggaattacacaaaggcatggacatcaggaagcaggaatcactgtgggtcactctaggatttgttatccacaagggatcacattatctgcttagaatttcaaacgaataataaaaccaaaaaaagttggtctgccttttaaaaattttcccttatttaaaactttattcttaataaagaaaaatgagaaaaccccaaaactttcttctttaattggcaaccttcaaaaaagatattcacaacaggactcagagcaagggcagagatccccaaagagatggtttttccttaattcatcaggctggagcagagtttaaaccaagctggaaccactccggctctggccacaacctaatctctacatcctggcctccatcacattggccggaagctggttcgcttcatccaagggtctagtttgagggcattcatggcttctgcaagtttgagcatcccttgctcctggtgctggcagtgccactcagccatggactggagcatccacttggtttggagcttgtaccaataggagctgtaaaccacgacctcggtgaggtctgaagactccagagccttcagctggagcatggccttgctcatctgctcgatgtaagggattatccatacgggcctgctgggggaaggggatgagagctcccagcgactcccgtcaccgccccgcagcgcggcccccacccggcgccgtgacgccggcccgccgcttccgctctgcccatatttggctcagccactgcgccgccggcccggggagcatttttttttctactctgataatgacaactcaagtaattacctgcaagacaagaagaatgaacaacagtcaatgcaaaatgttagaaaacatctgctttgcagggcttgtctatcaaagcccgactctgtgcctgaatggtgttcaggtccctgaagctattgatttttacattgtcaagtgtggtaacattacatcctgtcccaaaaccatagtgagctcttctcttcattgtctatggtccattctaaaagttgaaaactatcaaacggcacttcaagtagagtattttgtgcggataaatgagcacaatttctgcactgccattgccacaaacgccatcactatcaccatcaccatcacaaccattactactaccatcaccatcaccaccaccaccatcaacacctataccataactaccatctccaccatcatcagcaccattatcatcaccatgccaccaccaccaccactgccattgccaatgcctgagtggaagaggagtggaggagcgaggtgcctgagacagaattttctcccccaaatcctccattatcaccattgctgctaacaccatcaaagctaaaacttgaggctgtttctatacctgaagcctcaatgtgcttattaaagtgctaagtggctagaacagattcagataatccagggtcttgttgctcaaagtgtggttcatggaccagtagcactggcatcccctgggagctcgttagaaaggtagaatcttagtcattaccccagacctacataatttccatcttaacaagatacccaagtagttcacatgcatgttgaagtctgagaagcgccactctagagcagggcttggaaacctacaggactcctagaggagacagtgctttcattattgtctgtcttttggatagaagctgttctaactggggtgagatgatatctcactgtggttttgatttgcatttcttgatgattaatgatgttgag

SEQ ID NO: 461766 - DNA, 913 bp, Homo sapiens
  misc_feature (1)..(2): n is a, c, g, or t
  misc_feature (4)..(4): n is a, c, g, or t
  misc_feature (8)..(9): n is a, c, g, or t
  misc_feature (13)..(13): n is a, c, g, or t
  misc_feature (15)..(17): n is a, c, g, or t
nnantgcnnacangnnnagttataattattttttaggctatggctttgtgtcaatacttggaggaacatgccgaggaactgaatttccaagatgcaaaaatacttgaaattggtgccggaccaggccttgtttccattgtggccagtattttaggagctcaagtcacagcaacagatttgcctgatgtcctgggaaaccttcaatacaatcttttaaaaaacacactacaatgtacagcacatctgcctgaagtgaaagaactggtatggggggaagacctggacaaaaactttcccaagtcagctttttactatgattacgtcctagcctcagatgtggtctaccatcactacttcctggacaagctgctcaccaccatggtgtacctttcccagccagggacggtgctgctttgggcaaacaaattcaggttcagcaccgactatgaatttttagataaattcaagcaagtttttgacacaacactgttggctgaatatccagagtcatcagtcaaactttttaaggggatactaaaatgggactaaatccaacaaaatgcctttcacaacgttactgtgtcttttgagcaatgtgttagaaattgctttggtaatagacttctttcacaggattgagaaggtagtgcatagaaacaacttgtatacttggaacaaatgtaacaatactgcagaaactttctaatttctaagataatttaagattatctggttaatctaaatatctaaaaagaacaacataaaaacatgaaagtagctttgttggttccaacgaagttacatgtttaataaatcttacatggataaagtaataagtgaatttcttccctatttctgctatagagcatatgtttaaacttggcaatatagtcttgtcacatgctttttgaaa

SEQ ID NO: 461767 - DNA, 901 bp, Homo sapiens
tctctaataatctcaccgctacaggctatggctttgtgtcaatacttggaggaacatgccgaggaactgaatttccaagatgcaaaaatacttgaaattggtgccggaccaggccttgtttccattgtggccagtattttaggagctcaagtcacagcaacagatttgcctgatgtcctgggaaaccttcaatacaatcttttaaaaaacacactacaatgtacagcacatctgcctgaagtgaaagaactggtatggggggaagacctggacaaaaactttcccaagtcagctttttactatgattacgtcctagcctcagatgtggtctaccatcactacttcctggacaagctgctcaccaccatggtgtacctttcccagccagggacggtgctgctttgggcaaacaaattcaggttcagcaccgactatgaatttttagataaattcaagcaagtttttgacacaacactgttggctgaatatccagagtcatcagtcaaactttttaaggggatactaaaatgggactaaatccaacaaaatgcctttcacaacgttactgtgtcttttgagcaatgtgttagaaattgctttggtaatagacttctttcacaggattgagaaggtagtgcatagaaacaacttgtatacttggaacaaatgtaacaatactgcagaaactttctaatttctaagataatttaagattatctggttaatctaaatatctaaaaagaacaacataaaaacatgaaagtagctttgttggttccaacgaagttacatgtttaataaatcttacatggataaagtaataagtgaatttcttccctatttctgctatagagcatatgtttaaacttggcaatatagtcttgtcacatgctttttgaaa

SEQ ID NO: 461768 - DNA, 4376 bp, Homo sapiens
gcattcaacttaaatgcttttattgacaatgtcttggaacaataagcaaacaatgcttaaatttttcattcaaattcactttccacatgtcaaaagacctcaaggtagaaaaaaataaaataaaaatataaatatctgagaatccatcttaataaataaattaaaaacacaataaaacgttttcatggaaaactgttaatgtcagaacattcagaccacctcaacaatgcatgatcagtaacattacaatgaacattgatgttgaagaaaaactacagtacatggatatagctatttatttctatctaccagaaaataaagtcgtatcttttcttagtataatattggtcatttctaatcagaacacactattgccaggaacacagtagttattgttaaaatcagctgcactagatacaatttgaaaatatccagcaccaggttaattccaataatgaacccaatagattagttaatgctatgagaagactaaggagaaagagaaaagagacacagacccaggcctggctcaacatgctactaactaccagctctctgaagtgtcactgggaacaatacacactccatgcgttttgctacatctccggaagaggtaaggacttgagtccacacatggatgctttcaagtccttgaggcccacagcctggtgtgtttcacgcacagataaggtcctccctaggtctacaggaaccctctagggaagatgtgtttctcctctctgtaatgcaccagctcgggcagtggcacttgtgggtgccggctgcctccccttccctgccccctcacagggccagcagcgtgggtgagctgagcgagtcagaggaaggctcattgctgctgctgcccttgcggtgggcagctgcacagctggggaaggagtcagcctcggggtaggtgaagacgaaggaagacgtgtaagcagtgcagctgggagtacagtgaccgtgggaatgaagttggcactggagacggccaggtccgtgcagaagtcctagaacaaaacagaaggggaaagccgacgtgagcgagcaggttccggacacaggtggggcgagttcccagtgccgcatgcagcagtgaagagaaacgatcctgccacggacatttcatcttaaatgtccctcatcctggatgaaaggtctcccccttttcctcccaggcattccgcagcgcagtgcctgtctcttccatcctgccgctgcgttcccgttatcccttcagcatcacttgcttgaaagggggtttgttataaatatccctgacgtctgcgctgacgcaggcgccgctccggagtctccagaatgaactcgctttttatcaatgaaactgccttacacacccgcccgctgcaccctcctccctcatccctcctccgtgctccaggctgccgggggaggggggattgccgctttctgccacctccccggagaagccaggctctagttagcgagtttgtgcttgggacacgtctgctccagctaatgtcagagatccgtcctggagtgcagaccagaggttgctcagaacgaacctgcctcccgaagggggaaccaattcttactatggcaagcgtgcgtgcgctcagagcaagtcccgagcccccgagccggcaccgctccggccacggcagcctccctccaggcacaagggagccccctactcatctactggagcgtcccgcccggtgtctcctcctccgcgaccccaagcccccggccccgcggcgacgggaagccagccttacctgcgcgttgacaggcgagcccatgctggagaaggagtctgcgggtgagtggtagtaagagaggctatccccggccggggacgcgctgctgcagcgggaggatgacgcctcgtagtctgcgttgaagcccgagaacatcatcgtggcggttaggcaaagccgggcgaggggccgaggggcggagacaggtgggcgctgtggagcagagctgggtaggagcacggtcactgctcgttcgctgcgccgcggccgccggctcagtcttggcttctcagatgctcgctgcagatgcggttggagtacgaggcgccgcagccactgcttttataacaagcgttttatgaatgagtgtaaacgtcacgggctcaaccacggtggcgccagaggggtggcgcgcgggcctgggcgcttctgcggccgcccggctgcgtccccagcgctcgcagctccctgcccccgccttggcgcgtgtcctaatctcgtgagcatttcgcagttcctgtctcagaggtctcgtgggccccccaagatgaggggtttcggggatggctccccccagggctacagggaaaggccgtggaaacctgctgacgcagatgtcctaatatggacatcctgtgtaaggggggagggattgacgggaactgctcgcgggctgcagccaacaccgagggtgcagtgcggggggaggcgggggccgcggctgggggaggggaggcgggaacggcgcagaatgagagagaacattcgcacctggttcaatgcggacccttgttcccgaggtcgggggggatggggcagagagcgcctttttacccttgtacggaaactgaagacagttctgaggctcagagataggagaaacggcatcgagtacaggaccccgaggacttaagcctcggctcccgaaggaatgcgcccctacccccatccccaattctagccctaattcagtgcaaagcgtggaagcagaccttcatcccctaacctccagccctcgggctcgagcaatactagcactgttcctgcgtttggaagcagaaagtggaggatccaaaataagagaatacgataacctactttacgatactgggtactttatttatttatttttttaaagaagacagcgcatttatttatttatttttctcggccatgtgtgggaatattaaggaaactgtcaaatccctgagacaccagcagataaacactgtgcaaaacctacgtgcgaagacatttgaagggggtgtctgcccggttctgagctgggccccaggggtagggagtgcgaggaagctgtgcttacgggagcccgcagcgggtgattttccagcgcggacttggagggtggaggacgggggctggaaggacagtgtccagctgcgcctgggcggaatacctcgactgctgggaccccaggagcggctccacgtcctggaacacggggctttggggaggcaaggtgctccagagtgtgccacgccccccaatctcctgccctgctgcgtaggacagccggggtcacgctgccggggctcagccccagcgcgctggccacctccagggcgcgaagacgcatgtccccgcacagccccggtcttcccttctccactcttcgggcccgggggtcggggcccgcgccgccgcgcccgggagccaggagatcctgctatagatagtaacagggaagcggctgtttacagcaacacagcgccgccagggccgtctccaggcaacgccgcgcggccgggcgcgccgtcggcctggcgaggccaccctccctcccagctcccctgggccgcggcctccccggcccggccgcggccgctcccgtcgcctgacatcatccgccgggtccgggggctgagcggcccgcgcgaggctgtgcgctaacctccattcttagagatccaacccggcaggagcggggagggcaggaggcggggattcgtggaactgggccacttgctatttttgcattccctgtcacaggcagaggtgaaaacagaatttcatcattgtatgtcattggtttatgttggtgggaatttaggcgcttttttttctcactcataaaaagggagggaaacggaaaaacacacataatacgtaaacacagattccttggagctgctctgaatcctaaagcaattctgcggccttcggtacttctaattctatccttgattacagaaagaaagagggggacgggagggaaaggggttatgaagccaaatacatctctcttattattaatattagcttcagacaaaataggtcaagctttgaattcctgagtctggccatgactgccattcacaactagatctcaggccacttaacaggaaacctgactgggtgcggtggctcactcctgtaattcctgcactttgggagcccgaggcgggtggatcacttgaggccaggagttcgagaccagcttggccatcatggtgaaactctgtccctgctaaaaatacaaaacagccgggtgtggtggcgcacgcctgtagtcccagctactcaggaggctgaggcaggagaattgcttgaacccgggaggcagaggttcctgtgagccgagatcgtgccaccgcactccagcctggg

SEQ ID NO: 461769 - DNA, 5650 bp, Homo sapiens
ctcctgaggcacactggactggtccccccaaccccggtgccttgggctacccccaccaaagttttgtcagtcagccccaccccttcagcaagcagcccagtccttgccctcgccaatcaccccagggtgactttgggtgggtgactcctggggcttcccgctccattactgggccctcatctcctgccgccccaagcttgatctccgtgggctctttgggctctcatctccaaggagccaggccccaccctcgccagtcatccttgggtgactttgggctggtgactcctgggactccctgctgcagactgtgccctcccctcctgctgcctcaaggtgggactgggtgcccctctgccagctgagacagcccacacaccccagccctaacgatcgttctctctacctctctccccactcctgctccacctcctcctctctgcatgcacctcagagcccgtgccaagaacgagcagtagtcctggattcaacacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagaaaagaaagcaaacaacgagagacagaaagccgaaagggtgctagaggttcaaatccagacattgatcatacagaaagaggaactaaatacggacctgtaccacatggaacgttctctcagatactttgaagaagagtccaaggacctggctgtccgcctgcaacattcattgcagtgtaaaggagagttagagagggctctgtctgctgtcatcgccacagagaagaagaaggcaaaccagttgtccagctgcagcaaagcacatacagagtgggagttagagcagtccctacaggaccaggcactgctgaaagcgcagctgacacagttgaaggagtcatttcaacaactccaattagaaagagatgagtgtgctgaacatatagaaggagagagggcccggtggcatcagaggatgagtaaaatgtcgcaggagatttgcacattaaagaaagagaagcaggatatgcgttgggtagagcagctggagtggagcttgtccaaactcaaaaaccagacggctgaacccttgcccccggagcccccagcagtgccctctgaggtggagctgcagcacctgaggaaggaactagagagagtggcaggagagctccagtcccaggtcaaaaacaatcagcacataagtctcctgaaccggcgacaagaagagaggattcgggaacaggaagagaggcttcggaagcaggaggagaggcttcaggagcagcacgagaagcttcggcagctggccaagccacagagcgtcttcgaggagctgaacaatgagaacaagagcacactgcagttggagcagcaagtaaaggagctacaggagaagcttggcgaggtggagctgaagagccaagaggttcagagtctgcagcagcagccagaccattacctgggtcacctgcagcagtacgtggccacctatcagcagcaggtggccgcctatcagcagctgacctgtgagaaggaggcgctaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtggggagacccaccgggccctgcaggaagtcacggagaagctggcccatgccaggactcacctccgccttctccatgacttgaaaatgccacctgagggcaggtcgctgccgagatgtgactgcaatattttggctccagagcagctttatggaccacctgaaggagaaggcagacctgaggccatcagaggggccccagcgtctgagccctgtcctcccgcaggaaaatccatcaccttttatcagaaccagggggccgtgccaaagatgcagcactgggaggaggacaccatcaggctggagctcagggaggagatgaaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtgatcttcgtgaggtgaccctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatgtaatcttaatcacagtgagctcttccttagctcaatatgtagtttgcccccaagtgtgcactgtttattactttgtaatacgccactatgagtactgacatttagagttgtttaaaggccaagaattggaaacagcctttcctccattttctgtgtattggtgatgggagtgataaccttttgggggagctttttaaatctcacagaagaggaaagtggcctcctctggcaggtacgtgcaggatagagtgtgtttcatctgttccggtgccaggaattagcagtgtattatggtggttcccttaggatttgtatgtgctctgggctcatgaagatactgcatcatgagctgcagcagttgcactctttttcgatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgccccagtacacaaaagggcactggttggcattcttcttaatgtatttagtgaagatcataagaaatcctttacgagttcaaatgtccctggaacaggcatacaggctctagtcaagaatgaattagagtgaaggaaagctgtgtgactcctggcattcctctctgttcacggagattctttgaggcttgaagattgattttaccatctagacctctttggctaatacctattcttcaaccaccttggttactctgacataggaatttacttctttttctttgaatggaaaacactttaaaaaaatagaaacattcttataaactaatatatgtgagatagttgaaacaaaaaggagttttagtagatggtattatactatctttgaaaatcaaggagaagtttatgaaacttaaaatgtgtacaaactgcagtgcaatctactgttgttcgtgaatgtcaatgtattatcaggaaacgtgtctatacaaccacagagttatattttctcacaaacttctttacaaagtgaaatatgtttttgtacctctgggtttctgttcgggacatattttgtgcaatatttatgtgattgtgcctatgcatgatgaatgaatgcatttcagttatgtattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatcttagaccaaataatgcggctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagctaaaaagaatggaaattgtatgacaataactcaagtctttctccaaagtgcatgcagtcttttgtgatacctcattcagccgagtatttgtgctcttcctcattcagtataaggcagctttcagtttgcttagaaggcaacattggaatgttagagttcatcagaaacatagaattttaaactgtgagttccactgaatacattttgatttctgtaggaagaatcaaaatacctatttaaagatggcaatgtataataatcattttaaaagtatttgattaaacctgataattttccagaaatgaaaaaaaaaatcagctctaaaaccaaagctgattttagaaaatttgaaaatgtaaatcagccctatccataatatagtttctctaaaactttattttaaagagtcattttaaaataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaagagaatgtgtcgtggaaatactgaaagatttttccctagagtggccttattgactgctg

SEQ ID NO: 461770 - DNA, 3046 bp, Homo sapiens
gtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactcccctgcaggggatttcacagcccaaatggcgggaccgtccaggggctccaaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagctgagcttcctggaggaggagcagctgctgttgctggtgaccagcacattcaggaacggagactactctgtcaacagacagggggatgacctgagtgctcaggccactccgggtcacgcaggtcatttgccggcccctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttacttgaaccaaggccaggtttcctaatgaatgcagggaggacagcacagatcaatgaaaccagcagataatccacaagactgtttcccagagctgggaaatttccttccctgccaacacttttcctgaaagttcttaagaatgaggcaaacagtttaagtctctctcgcactgttcttttagtgaaagagttcaatgaggaaagagaggaagtggagcatatgcttagtttccaagctggaaaagtggcccatggttaaccaagactagatgtaaaagcacaggtgtccacgggtccaggtgagccggtcctacgatggcatggctgctaatgccagcagatgctcctgtcctctcctttcaaagactgacttcttctggtctttcattcgttaaaataaaattgacagggcatcatccgagaagctctacactttcccttacttggatttcagactctagattcggctgagatttgagcttcatggtgaacacattcttggtgtgcttgctgctgaggggtgtggaggacagagagatggtgaaatggcaaagtgactcttgagcatgggtgggggaagcccccacatgtctgagtcagtgccacctggacactacccttggagcatcctgctgaggtggccattccggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccagg

SEQ ID NO: 461771 - DNA, 2958 bp, Homo sapiens
ctacaccgccaaggctcatttggggattgtacagtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactcccctgcaggggatttcacagcccaaatggcgggaccgtccaggggctccaaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagctgagcttcctggaggaggagcagctgctgttgctggtgaccagcacattcaggaacggagactactctgtcaacagacagggggatgacctgagtgctcaggccactccgggtcacgcaggtcatttgccggcccctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttacttgaaccaaggccaggtttcctaatgaatgcagggaggacagcacagatcaatgaaaccagcagataatccacaagactgtttcccagagctgggaaatttccttccctgccaacacttttcctgaaagttcttaagaatgaggcaaacagtttaagtctctctcgcactgttcttttagtgaaagagttcaatgaggaaagagaggaagtggagcatatgcttagtttccaagctggaaaagtggcccatggttaaccaagactagatgtaaaagcacaggtgtccacgggtccaggtgagccggtcctacgatggcatggctgctaatgccagcagatgctcctgtcctctcctttcaaagactgacttcttctggtctttcattcgttaaaataaaattgacagggcatcatccgagaagctctacactttcccttacttggatttcagactctagattcggctgagatttgagcttcatggtgaacacattcttggtgtgcttgctgctgaggggtgtggaggacagagagatggtgaaatggcaaagtgactcttgagcatgggtgggggaagcccccacatgtctgagtcagtgccacctggacactacccttggagcatcctgctgaggtggccattccggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccagg

SEQ ID NO: 461772 - DNA, 3200 bp, Homo sapiens
gtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaaggctccctctgggctacagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccgcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactcccctgcaggggatttcacagcccaaatggcgggaccgtccaggggctccaaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagctgagcttcctggaggaggagcagctgctgttgctggtgaccagcacattcaggaacggagactactctgtcaacagacagggggatgacctgagtgctcaggccactccgggtcacgcaggtcatttgccggcccctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttacttgaaccaaggccaggtttcctaatgaatgcagggaggacagcacagatcaatgaaaccagcagataatccacaagactgtttcccagagctgggaaatttccttccctgccaacacttttcctgaaagttcttaagaatgaggcaaacagtttaagtctctctcgcactgttcttttagtgaaagagttcaatgaggaaagagaggaagtggagcatatgcttagtttccaagctggaaaagtggcccatggttaaccaagactagatgtaaaagcacaggtgtccacgggtccaggtgagccggtcctacgatggcatggctgctaatgccagcagatgctcctgtcctctcctttcaaagactgacttcttctggtctttcattcgttaaaataaaattgacagggcatcatccgagaagctctacactttcccttacttggatttcagactctagattcggctgagatttgagcttcatggtgaacacattcttggtgtgcttgctgctgaggggtgtggaggacagagagatggtgaaatggcaaagtgactcttgagcatgggtgggggaagcccccacatgtctgagtcagtgccacctggacactacccttggagcatcctgctgaggtggccattccggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccagg

SEQ ID NO: 461773 - DNA, 2830 bp, Homo sapiens
gaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactcccctgcaggggatttcacagcccaaatggcgggaccgtccaggggctccaaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagctgagcttcctggaggaggagcagctgctgttgctggtgaccagcacattcaggaacggagactactctgtcaacagacagggggatgacctgagtgctcaggccactccgggtcacgcaggtcatttgccggcccctgtcataattattgccatatgagagtgccacccgtcctatgacatattttatatatttctgtgaatggcctacttgtttgtatttatgaatttatgtttaaaggatgggcaggggtgctcgagaggtccccaggagtttccctctggggagagaggggcccaccccttcccagcagccctctgagccccccgatcgcttggccacagcctctgcctggagaaagcatccccctcggagatatatggacatcagaagaaacctttctctgtcaccaggacaaatcctgttcttacttgaaccaaggccaggtttcctaatgaatgcagggaggacagcacagatcaatgaaaccagcagataatccacaagactgtttcccagagctgggaaatttccttccctgccaacacttttcctgaaagttcttaagaatgaggcaaacagtttaagtctctctcgcactgttcttttagtgaaagagttcaatgaggaaagagaggaagtggagcatatgcttagtttccaagctggaaaagtggcccatggttaaccaagactagatgtaaaagcacaggtgtccacgggtccaggtgagccggtcctacgatggcatggctgctaatgccagcagatgctcctgtcctctcctttcaaagactgacttcttctggtctttcattcgttaaaataaaattgacagggcatcatccgagaagctctacactttcccttacttggatttcagactctagattcggctgagatttgagcttcatggtgaacacattcttggtgtgcttgctgctgaggggtgtggaggacagagagatggtgaaatggcaaagtgactcttgagcatgggtgggggaagcccccacatgtctgagtcagtgccacctggacactacccttggagcatcctgctgaggtggccattccggttttctttcctttccttttattccactgtttctgaatcacaaataaagatccaaggcaaacagcacattcagatccccaagctctccacctccaatgtgaccagggacgtgcaccacttcaggctcatgcaggacccacagcctttggacctcagctaagggacctgcttctcttcagcacacggggcttgtttgtgttggggtctgagccctgagcgcatggtcaaggagacccccagg

SEQ ID NO: 461774 - DNA, 1833 bp, Homo sapiens
gtgcggggccgccgccgcccgcaggagccgccgccgcctattgttcatgcgcctccgcagagctgggaggacccccccccaacgacggcggccgcaggggcgcagcgggccgagtccccgcctgcccgctcgcccccccgggggcggcctcgtcacctctgccgccggtacctgctcgcgcagccggtgcccgccgctgccagccggccgccgctctcctctccgcgccgtgccgtgccccgccccccgcaccgccagctcgccgggaccacctgacgcgggcctggctccgccccagccctgcggaccccagggggctccgccccacgcccgccccgccccgcgcccgctgccttcccattggctgcggccgcccagtccccggttcctccgccgtggttggggcagcctagctggccgtctcgcaggtccctctcaccccctgcgccgccgtcgcaccgtgccctcccccattgcgggctctgtcattctcaaacccaggtcgacccactcttcccgcccactggcccgccgcagctccctccattggctcgcggcacctgtccgtttcctgggagagttcagcacctcccggcaggaagaggctccggcctcattgggtgcgtgagaagggaagggtggatcctaaaaggtaatactgagccttcattcaaactaaaaggctggaagggaggcagctgcctttgtttgccatggatgggtaggggctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccggtaagaagagattccaataccactcttttttcagaattcagaaaggcaagagaccaccttactgagcttcaaactggggctgggaacgctgccatgaattgggcttggtctgtctgaagggagccaccttttcgacaatccttagacttcttttgcctgttggaattacaccttggatcgtggcgaagtctatagaggtcagattaagaagaaccaaagcagaataaacgtagaacccgatgctgagttcacgagtgaggacgacctcttcctatatgctttgctataccctgcgttttgaacattaaggacgagataggaggcccataatgtttcttcttgctttaatcctgtcgtggcaacgttgacttccacctggttgcagagtgagcccatgggacagccctctgaaattatactgcttacaaccatgctgagtctgcaaggacttcgtccaagcctttccgtccaggacctcaaacagatccaatcacaagaagagagatttcaggaaagagaaaattattcctatcatcggggtttttgaagaacatgaaatgactgggaaaataatcatgttaagtggaaaaaaaaaagaaatctatctgttgtaattttcaaataatttttaaataaatttgaaaaattaagagaactatatatataatacattcctaatcttgtgaaaaatatatatgcattaatattattgaaagaaatatatcaaaaggtgaacagcaattatcaccaatctagattatgagattaggagtgattttttttctttgtcctatactatttaatattttctaccattaaaatattctga

SEQ ID NO: 461775 - DNA, 1459 bp, Homo sapiens
gtgcggggccgccgccgcccgcaggagccgccgccgcctattgttcatgcgcctccgcagagctgggaggacccccccccaacgacggcggccgcaggggcgcagcgggccgagtccccgcctgcccgctcgcccccccgggggcggcctcgtcacctctgccgccggtacctgctcgcgcagccggtgcccgccgctgccagccggccgccgctctcctctccgcgccgtgccgtgccccgccccccgcaccgccagctcgccgggaccacctgacgcgggcctggctccgccccagccctgcggaccccagggggctccgccccacgcccgccccgccccgcgcccgctgccttcccattggctgcggccgcccagtccccggttcctccgccgtggttggggcagcctagctggccgtctcgcaggtccctctcaccccctgcgccgccgtcgcaccgtgccctcccccattgcgggctctgtcattctcaaacccaggtcgacccactcttcccgcccactggcccgccgcagctccctccattggctcgcggcacctgtccgtttcctgggagagttcagcacctcccggcaggaagaggctccggcctcattgggtgcgtgagaagggaagggtggatcctaaaaggtaatactgagccttcattcaaactaaaaggctggaagggaggcagctgcctttgtttgccatggatgggtaggggctgcactgagcagcaccggtgttcttcatccggctgcacccccaacagagctctttcttccccagatcccttttacagttggattctccctcttggatctggctctgccttagtccgacctagagggatcagcttcgcccacgcccactctcacccggaacctttcatctcttattgaagccttttaggcccattgggatgttcattagaactctgaaaactacagttctcccctttatgaggactgcaccacagctcgccctctcctgggttccgcctggttgcagagtgagcccatgggacagccctctgaaattatactgcttacaaccatgctgagtctgcaaggacttcgtccaagcctttccgtccaggacctcaaacagatccaatcacaagaagagagatttcaggaaagagaaaattattcctatcatcggggtttttgaagaacatgaaatgactgggaaaataatcatgttaagtggaaaaaaaaaagaaatctatctgttgtaattttcaaataatttttaaataaatttgaaaaattaagagaactatatatataatacattcctaatcttgtgaaaaatatatatgcattaatattattgaaagaaatatatcaaaaggtgaacagcaattatcaccaatctagattatgagattaggagtgattttttttctttgtcctatactatttaatattttctaccattaaaatattctga

SEQ ID NO: 461776 - DNA, 495 bp, Homo sapiens
taattcctctatgaggaattatgagttaatgtagcttgaaccaccaaaaaggtaagaaatctttcctcttttaggaaaacctcagttcagaaaagcaataaactatggggggggtggctgtttagaatgttgcatctctggagagcaagttgcattttaacaatgatcagagcctttaattaaggagtgaaggtcaaatcatttctgcttcatccagcctggttgcagagtgagcccatgggacagccctctgaaattatactgcttacaaccatgctgagtctgcaaggacttcgtccaagcctttccgtccaggacctcaaacagatccaatcacaagaagagagatttcaggaaagagaaaattattcctatcatcggggtttttgaagaacatgaaatgactgggaaaataatcatgttaagtggaaaaaaaaaagaaatctatctgttgtaattttcaaataatttttaaataaatttgaaaaattaaga

SEQ ID NO: 461777 - DNA, 978 bp, Homo sapiens
ttgccgggcatgtacaagcttcagtgcaacaactgtgctacaaatggagccacagagaggaaacaagcagcaggctcaggagcagggtatgcgctgccttcggctctccaatccatacctcagggctcctatgccactgcacgattcttggttgccaagaggccaaccacaggccatcttgagaaggagtttatgttccactgcagaaagcagccaggatcaccatccaggggacttggtcttctgtggccctggccagacatagaatttgtgccaaggcaggacaagctcactcagagcagcgtgttagtacctcaaatctgtgcatgccagacaaggccaaactggctcaatgagcaaccagccacctctgcaggggtgcgtctggaggaggtggaccagccaccaaccttacccagtcaaggaagtggatggccatgttcccacagcctgagtggctgccacctgatggctgatggagcaaaggccttaggaaaagcagatggcccttggccctacctttttgttagaagaactgatgttccatgtcctgcagcgatgtctccttcaggagctcttgtaacacaagaatgtggatttatttcttgtaaggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatggtatgtatactttctgatcactcagcatca

SEQ ID NO: 461778 - DNA, 435 bp, Homo sapiens
gacccgttggcataagattacatcctctgactataaaaatcctggaagaaaacctaggaaatattcgtctggactttgcacttggcaatgaatttatgggtaaccactgatccacttccagtcactatccatgagtttttatttccaaatacatgaaatcatatgaatctgcaaagggacatttgtgagaccattgtggccaatggggcaataggaaatatcttcacataaaaactagacagaaactttctgggaaacttctttgtgatatgtgctttcatctcacagagttgaacctttcttttgattgagcagtttggaaacagtctttttgtagtatctgcaaatggatatttggagcactttgaggcctatggtgaaaaaggaaatatctttacttaaaaactagacagaagcattctgagaaacttcgtt

SEQ ID NO: 461779 - DNA, 838 bp, Homo sapiens
gcacggggctgctgtaaggccgaggttgcggcggaagcggagaccatgttccgagcggcggctccggggcagctccggcgggcggctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgtttctgtccgtggaacatcctttgatgctgcagcaacaagtgggcggtagtgccagttcagaaaaggcatcaagtacttcaccagtggaaatatcagagtgggttgacccagaaattaccaaaaagtgttcgaccagagctaacaggtgccaaagtggtggtatcctggtggtcgaggcttgaaaagtggggagaactttaagttgttatggacttggggatcaactaattctgcagtggggttcccggcgtgttgagctggttgttccaatgacatgcaagttggacagacgggagaa

SEQ ID NO: 461780 - DNA, 467 bp, Homo sapiens
agggcgaggccccgagtgcacgctaacattattcgaccatggtccacggtgaacgttcctcatcggaaccgcgctggggcgagcgctttaagcctcgtccaggctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaatggggttttgctatagctgcccaggctcttcttgaacttctggcctgatgc

SEQ ID NO: 461781 - DNA, 1102 bp, Homo sapiens
gaaacctaaatgcttgtatagtaggcgccccctatgaccatctacactgaacaagatttatacaatcatgtcgtacctaagccccgcaacaaaagggtacccattcttccttttgttatcggagcaggagtgctaggtggagtaggtactggcactggcggtatcacaacctctattcagttctactacaaactatctcaagaactaaatggtgacatggaacgggtctctgactccctggtcaccttgcaagatcaacttaactccctagcagcaaatcgaagctgcaaagctacaaatggttcttcaaatggagccccagatgcaatccatgaaaagcaactggctctgctccattatgagcaagttgaaaaattcacagcccatctggtcactcagaagagatctggaggacagggagaccaccaccagagcctgcagcaagtcttccatttcctcctcatcagcaagcctgtaggacctggggtaacgcagggggatctcaccaggtctactctgtgtgctgctcaggtgtatcagccttggaatgatgcacactttccctgtgtaaccaccaacagtttgcagtttctgctttaactgatgagctgtgtttcgggcatattcaagtcctccaggccaattggggtctattaagattgtatagagtaccacggggctgttaactgctatcaggagagcatcacacaggacattctgttctttcctgaagccaacatcaccagcccagcttctagaaaatatcacaatcccctgagaacaaggatgtatcagggtcttcattaaaccctccagttctttatgatctgagaacagcttcttacagagggattctggtttaaattgtacctcttcctgtgtcactgaaaattcaaggaatagatgttaccaaaacttacaaaagcatgtgagcctccttaaatttgtggacttttatgggatatccgggactttttcgtgcagatgaagctgatgaaatcaggcaagagttgtagtctgtgaccaaactgggaggagctagacaattacatggaaagttgtttcagacaaaaaataaaaagttaaaaaaaaaaaaaaaaaa

SEQ ID NO: 461782 - DNA, 1248 bp, Homo sapiens
actggtcgatgtgggagttctgacctgctccctttctgaccttggccagttcagccacccttaggcaacttggtgaccgcccgctcacaggaggtcaccacactgatgccgaacttagtgcaggcacccggtcggcataatgaccagctgctctaaaggtcagctgctgataggcggccacctgctgctgataggtggccacgtactgctgcaggtgacccaggtaatggtctggctgctgctgcagactctgagcctcttggctcttcagctccacctgcaggaagaccctggctgcgctttcagcagtgcctggtcctgtagggactgctctaactcccactctgtatgtgctttgctgcagctggacaactggatggtgaagagtgagaagtttcaatctggagagcctgggcatttccacacagtgccccttaacagggctagggctaggcccaatatacaactcggaagaggaagacagagctcttaccagggggaggcagagatggcacagcaagagacatgcccccagaatgccaccaatgccccaggacaggcccacccatgggaccagatcatctttgtaacaagaagaaaaccaaccaaatgaaaatgaaatgaattctctcaaaaagaattaagtcaagacaggaagaaggctcgcaaagtaatataaaatatatcttatggtttatgtaaaattcttaataaaataccttctttgctcctagctgcactctggctttgcctttgagtcaggtggcatttctttgcacgatgactggttttattgagtaggcactgcttcagccctacaggaagaacaaaacctctctggaacacagcagcattcctgactcccacttgaggaggcctaacaaaacggcatatgcctcaacagcagcagatcagtgttaaaaagtctggagtcaaggggaaaaagtaaaattggaccatttccaaaatctcacaaaaagcaacaaactgacgttctaagtgcccaacatgagcaaattagaaccttaaataaaggtcactcttaatgcctatcccagcatagatgcagcaccaagtacagtgtcattttactggtttacctttttcattcttgaaagtaggagctatgaaaaaaaaacactaaaatttccctaagagaaccttctactttctgtctaacttacataatcaaaacactctattgagggtgaaaattgaatattataagaaaataatcacgtgttttgc

SEQ ID NO: 461783 - DNA, 1038 bp, Homo sapiens
tagtatgcatttactaacaccacatctcacccccacgaaacttggtaagggcagcaacagaactttatctgccatatgcactcctgtattcctattaccaaatagtgccagggactaagtgaatatttgtccaatgaatgagttttaagtaggaaacgtttgcatagaatcattttgtttcttttggagttcaaatcttcggatattttacccttcccaatccaaagaaaagtctctgagtgaagagatgggaacaaaatgaagaggaagacagagctcttaccagggggaggcagagatggcacagcaagagacatgcccccagaatgccaccaatgccccaggacaggcccacccatgggaccagatcatctttgtaacaagaagaaaaccaaccaaatgaaaatgaaatgaattctctcaaaaagaattaagtcaagacaggaagaaggctcgcaaagtaatataaaatatatcttatggtttatgtaaaattcttaataaaataccttctttgctcctagctgcactctggctttgcctttgagtcaggtggcatttctttgcacgatgactggttttattgagtaggcactgcttcagccctacaggaagaacaaaacctctctggaacacagcagcattcctgactcccacttgaggaggcctaacaaaacggcatatgcctcaacagcagcagatcagtgttaaaaagtctggagtcaaggggaaaaagtaaaattggaccatttccaaaatctcacaaaaagcaacaaactgacgttctaagtgcccaacatgagcaaattagaaccttaaataaaggtcactcttaatgcctatcccagcatagatgcagcaccaagtacagtgtcattttactggtttacctttttcattcttgaaagtaggagctatgaaaaaaaaacactaaaatttccctaagagaaccttctactttctgtctaacttacataatcaaaacactctattgagggtgaaaattgaatattataagaaaataatcacgtgttttgc

SEQ ID NO: 461784 - DNA, 2108 bp, Homo sapiens
gctcagtctggctggccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggctagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcactttcgaagcatcaagttcctttctttgac

SEQ ID NO: 461785 - DNA, 898 bp, Homo sapiens
aaatacggctagtagaggctgggttgtagcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggctagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcactttcgaagcatcaagttcctttctttgac

SEQ ID NO: 461786 - DNA, 1861 bp, Homo sapiens
acgagacttgtcttgactgtaaaccagtgtcggtggaattcggatgtatgacggagctcctccggctggctcccgcccggggccgctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggctagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcactttcgaagcatcaagttcctttctttgac

SEQ ID NO: 461787 - DNA, 1577 bp, Homo sapiens
gctcagtctggctggccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgccagaggatgatgagaggccccctgaggagtatgaccagccctgggagtggaagaaggagcggatttccaaagcctttgcaggtgagtcctggtggagagggcaggtcagctggggcctctgagcagctttccaggctcaagagaatggaaggagtggaccccaggaacccagagaggcccaggatcaggactccagggaaatgtagttgagttctgtaccatagggggtggggttggcagtgtggacacagcgctgtgtgcagggtcaaggaatgggtacaggagaaggatgaaggcattcccctgcatcaccacctcttggaagctaagaggcttagactacttctctcttttggggactgggtatatttaaaaataaattccaaaacaaacttatgaaactcgtgacatatgttaaaatacttacatttaacaaaagaaggcacttacttcaaacaataaagacagctatgggtgtaacctgaattctagggctctgcctcccagtggtaggccctggcggaccaggggtgtctggccccaaggagatttctgaggagcagagtgaggctgtgagaaatctcttgattgccaaatgaagatcaggtttcttctgtccatcccaagtccaagtccaccatggaaaagttcatgttagtggtctgaggtgggtggagcaagagcctggagtagggagagggcttttgctcctgggtccttgattcagggagaacataaagggctcaaatgccattcgacttcactcctgcctgcatatgcccctctcccctg

SEQ ID NO: 461788 - DNA, 2129 bp, Homo sapiens
acgagacttgtcttgactgtaaaccagtgtcggtggaattcggatgtatgacggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggctagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagcactttcgaagcatcaagttcctttctttgac

SEQ ID NO: 461789 - DNA, 1088 bp, Homo sapiens
gctcagtctggctggccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccccggaaggtgagggggccccctggccccgggagtcccgcctgccagaggatgatgagaggccccctgaggagtatgaccagccctgggagtggaagaaggagcggatttccaaagcctttgcagccagactggaaaaccacaggattctaatattcttcctgtaaagcacacaccattgaggatgggccgtttatctccagaagtctccttggagaatcaatactgtttggattgcttaatgggaaaatctatgctcgtcattaggaaacctcgttagcagtccagcagccgccagtggcatcactcttctcaggatggggggtggggattaaatttcaataaaac

SEQ ID NO: 461790 - DNA, 506 bp, Homo sapiens
agctaatacccaaactaaaaactgggtaactggccctgaagtgcttcccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaacgtgtacttcatcagatgcaacaaa

SEQ ID NO: 461791 - DNA, 8071 bp, Homo sapiens
tcctgggattacaggtgggaaccaccacacccagccccatactgcattttaattgtatgtttctcccactgaatcctatcctttaggataaaagctgtatgttacttacctttgcatcccagcactttgcacattgccttacacatattgtaaatgcctggtaaatgtttgctgaatggattaaagaagcataatattaacattgaataattagtagtgagctgcctcactctaccctacccacacatttgattataaatgtatatgagtgtaccaaagtggagagattgcatagcaagaaaatggaagagcaggacaggacacttggaaaaatctagaaaccaacttttaaaatatccccactattgtattttcctctattctttacctcaatcccccaaacaaggaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattcggaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacatatgtttaacatccattgaatgcaacgttttatttttggtattatcactgttaacacttttttttccttttcctggaaggtttgtcatttctctaaagtttgtacacagtatttatgtacataatattgtcactgtcttagtgtcttgttcatgttgtagggtaattttgatttattctttttaagaaggagtagagttgcaactggaaaacacagacaccagaaatgaaagtgttgggtgttgataggaatctgtacaatatgttgatggtggctgtagttgtttaaatggagacttccaatcaccagctcctgccaaattatgcattagtaactttttcctcagagacacccctaaaggctcccattaggtcacagcgtgactgaaagctgatttctctgtgagactgaaatcccagaacattgtttgccagtatctcaaccacagccaggaagtatatgtgagttgcccagagtggaagctcctagtagaggctgaaggccacaggggaggcctcagccaggggcaagtgcccacagtgactccatttaggatgctgtcgttttgctactgttgtggagatccttaacgcagcagcgcctgtcataaacaagcctcttgtagcttcttacagaaaacagatttagtctagcatgaaacacctctgcatctcattgaaactgaagaggcttgcagatttgctttcgttgatgtccacgttactgaggattgactgagtatagactggagacaggtttttggcttatcacagcactgaggaaaatacaaatgcacagactgtcagcatgatgtcagaggccagagtttggtgggggcagatggcagggcgacccaaaagatgcagaaaaggtagactggggccactgggtcttaagaggagctgtgaagttgtgtggaagccaaggctgggtctgacatccctgccaggaagcaggttggacagaaaccacttgctaaaagcgtctctatggtgcagtgattatgtgtaccctgtgctgttgctcagtagtctccttgaatgttcaagtatctcatccactcagttttgtgattcctggatatttgtgtgttgtaaagtgttttgttaggtggtatgaaccaatgtgaggaggcttgagacagggttatggatttccagagctcttccatgtagaataccctgccttcttgaagcagttccaccaccaatatgatggggaagggcaggaacttatggcagggtggggagagggtttgcctggaagttaagagagtggcatccacttgtggtaaccccttacgatgatgacatcccacacactaagaggtacaagcaggaccaaagttttggactgttccctcttctcccctccactgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaacgtgtacttcatcagatgcaacaaa

SEQ ID NO: 461792 - DNA, 2538 bp, Homo sapiens
cagtgagtgaacattaaacacagtggaggggagaagagggaacagtccacatgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaacgtgtacttcatcagatgcaacaaa

SEQ ID NO: 461793 - DNA, 8461 bp, Homo sapiens
tcctgggattacaggtgggaaccaccacacccagccccatactgcattttaattgtatgtttctcccactgaatcctatcctttaggataaaagctgtatgttacttacctttgcatcccagcactttgcacattgccttacacatattgtaaatgcctggtaaatgtttgctgaatggattaaagaagcataatattaacattgaataattagtagtgagctgcctcactctaccctacccacacatttgattataaatgtatatgagtgtaccaaagtggagagattgcatagcaagaaaatggaagagcaggacaggacacttggaaaaatctagaaaccaacttttaaaatatccccactattgtattttcctctattctttacctcaatcccccaaacaaggaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtgattctgagcctacacatgtgactttctagaagaaatgtttgtaaaaggggcaggtgtaatatgtaaggaacatgcactttattggttaattttataatattttggtcattttactgtttctggtgcatgcagggtttgggtgtttttcagtgtgtatgtgtgtgtatatgtaaggggaaagagagattgatctggatggcaagaccgtttatcattttttatttaaaaaaatcaaacctcaaaaaagtcattttcagagaacacctttatcaaaggcaaattgctgtttttcagtcagctgccacctgcttctcattttgccctctgagaaaaggcatggtttcttaattgagggaaggaagcagattcggaggggtggagataaagctggggattggagatgttcccctgcctttgtgatgatggtttggtttccagacctgaggcatcgaatgggctaaaggtcagccagaagtcagagggctctcagccttcatccagccgcagccctttagagttcctgaaggaggcaggttccgctttgctttaaaagagggtcttccggtgttccagagtgtatcgttacagtaagacatgataatggccggctctgcaaatttatcatatagtttttttcccaagaaaattatttttgaaattaaaacaggaccccaaatgaaatccaagtggtcttctgtagaggaaagcatgataagaggaggaagacataaagttgggggtggagaggctgctgcccagaaactgctgggttggtgggatccacacagatgggcatcttggctctccctgccagaaaaatgtgctctgcagtgtcctcccaactgaaaacaacagtgacatgtttgaaaagcagcaatcgaaagtcagtgtgttcttgtaaaatgaatatgtatgtagggttttaacccttccattacttgaataattctttgggccttctgagtttaatggccatattttcttccagtttattttccttccccatgctgttgtccccatgctgcctatttttttaaatttcatagattatatttgaattgttacatatgtttaacatccattgaatgcaacgttttatttttggtattatcactgttaacacttttttttccttttcctggaaggtttgtcatttctctaaagtttgtacacagtatttatgtacataatattgtcactgtcttagtgtcttgttcatgttgtagggtaattttgatttattctttttaagaaggagtagagttgcaactggaaaacacagacaccagaaatgaaagtgttgggtgttgataggaatctgtacaatatgttgatggtggctgtagttgtttaaatggagacttccaatcaccagctcctgccaaattatgcattagtaactttttcctcagagacacccctaaaggctcccattaggtcacagcgtgactgaaagctgatttctctgtgagactgaaatcccagaacattgtttgccagtatctcaaccacagccaggaagtatatgtgagttgcccagagtggaagctcctagtagaggctgaaggccacaggggaggcctcagccaggggcaagtgcccacagtgactccatttaggatgctgtcgttttgctactgttgtggagatccttaacgcagcagcgcctgtcataaacaagcctcttgtagcttcttacagaaaacagatttagtctagcatgaaacacctctgcatctcattgaaactgaagaggcttgcagatttgctttcgttgatgtccacgttactgaggattgactgagtatagactggagacaggtttttggcttatcacagcactgaggaaaatacaaatgcacagactgtcagcatgatgtcagaggccagagtttggtgggggcagatggcagggcgacccaaaagatgcagaaaaggtagactggggccactgggtcttaagaggagctgtgaagttgtgtggaagccaaggctgggtctgacatccctgccaggaagcaggttggacagaaaccacttgctaaaagcgtctctatggtgcagtgattatgtgtaccctgtgctgttgctcagtagtctccttgaatgttcaagtatctcatccactcagttttgtgattcctggatatttgtgtgttgtaaagtgttttgttaggtggtatgaaccaatgtgaggaggcttgagacagggttatggatttccagagctcttccatgtagaataccctgccttcttgaagcagttccaccaccaatatgatggggaagggcaggaacttatggcagggtggggagagggtttgcctggaagttaagagagtggcatccacttgtggtaaccccttacgatgatgacatcccacacactaagaggtacaagcaggaccaaagttttggactgttccctcttctcccctccactgtgtttaatgttcactcactgcattaaataacaacaaagatgggacaaaacccactaatactgtggggaaaaaaaattttcaagagcagaggaaagtctttctgcctttttataattactttttttatcatttaatttacctgcctaaataaacatcttctacagaatatctgtcattcaaccatgccaaggagtttgtgccagccttttcagactcccagaattgggtgttcctgggttatttacatagctgagcagtgtccaggggaggtgcgcagtgaactgtcaaggactttccagactgtcttctcttcagacttttataatctccagtggcatctttcccttttcttttgttcatgacctgacctgaagcagcagatttgatagactggcaaagatgaataggaaaaactttgactcttgcccagtgcctgcctgcctctctctctctcctctctctctctctctttttaaaccaccatagactctcacttattttggaggagtgtatgtgcatgtgtacacatatgtacatatataaaaacagttgatgttttggtgtatggggtaaaagccccaggagcatacagaacttgagctgaacctggtcagtagaaagggaaaccccaaccctttcttgatttttggagacacccaggactaatggatactgtagtagacatgtagtactatagtaccgtaatattcatctctcctcattttagttgcctttcagattctaaatgtttgggatcattcctatcatcttagtctcttcaggatctttagtattttcctggttctgaggaggcttgagacagggttatggatttccttgttctgtgtctttatccctactgatagttcctctttctcattttgcaaactacccagagctccaaggacagcctgaagatctcagtgcctcaggctctgaggtactctgctcacaggccccagacagatgctgttgggtaaactcaaagcttcctatgagaagcttctgagatgtagcaggtcacagaagtgttcacctgtttcatctgaggatttcagttctgaagtgatctaggcatgtttggtaaaaatgtttttgtgagagttctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggacttgttctaacatggaaaacaagtccagaagactctcctctgactgttacctttgccccaagccaccccaaacttttatgctcatgttttattaaagcaggtgctccctggaatctctgggacatttttgaggcatttgaagcagaatatagagtggtctcatctccttccttaatcttcctggtggttgggatgttccacttgtatcatagatttttttattacagatatgctccactgtttttaaatgtgaacttgtgcgcaaatgtgcagattcaatgttcttgttacagattgaataaatttttattttgaagatgaaacgtgtacttcatcagatgcaacaaa

SEQ ID NO: 461794 - DNA, 1623 bp, Homo sapiens
tacgttgaggtgtatttggtactcagatgctggaaatgcacggatgcactggaaacttgacctgtctagctgacaggcattgccggtcacaagctggacttgagcatagcagattttggcatctgcgggttgtcctgaaaccagtgccccacagatatggagagctgactgcattccaagtgaagttcatgaggattcctagagcagaaaagaagacagcaagcttagaggaagaaaacagcaatgttactgaaatttgggaggcagaggtcaaagttcaaggcttcagtagtggctggaaattaattctggagaggaggaaaccacgaagtgttagctctaaaatctgcacaaaaatgccaaacaggaagacccaactgccaatcccaagtgagattccctctgcatggaatagcatggatcacagcagtgccaaccactagaagtaggagcccaagacatcttctatgggttcagagctggggggcctgtgtcagaactaatgataatcccaccaccctttgctgacactctttttggactccggctgcctgcacccaggtgattaaaaagctttattgctcacacaaagcctgtttggtcgtctcttcacacggacacacatgacatttggtgccgaagagctgggacaggaggactccttcaggagaccagttcccttgtcctcgccctcactccatgaggagatccacctatgacctcgggtcctcagaccaaccagcccaaggaacatctcaccaatttcaaatcagccaaaatccacagtgatccacataatactcaggaatcacccagaagggatttctatctgaaaggagaaagaagctctggggcatgaatatacgttgtcttgtgaaaaaataaatcagtaattcatgtgtgtatattttatactcaatgggaaaaaatattttatttaaaaaaacactcaatattttacatgacattgtgaaaaggcagcacggaattactcatttgcttccttttttaaagttttagatgaaaaataaacatttaatcccatcacttgttcttaaatgtaatattattttgttgtcctttacaccccagttgtcacagagtctccagtatctatcatttccatcttcgcatccatgtgtacatccagtgtttagctcccacttataagtgagaacatgtggcattttgttttctgttcctgcattagtttgcttaggatagcggcctctggatgcatccatggtgctgcaaaggacatgatttcattctttttatggctgcatagcattccatggtgtacgtgtaccacattttctttagccagtccaccgtggatgggcacctaggttgattccatgtctttgcagttgtgaatagtgctgtgatgaatgtacaaatgcatgagtctttttgccagaagtatttattttcctctgggtatgtacccagtaatgggatcactggattgaatggtattaatagttctgtttttaagttctttagatgctgatttcttgcagctgttaatatatttttagacttttgaaagcaatagccaaaaaatacttccccttatctcttaatgatccacattgcagcttagagtccagtggtccacac

SEQ ID NO: 461795 - DNA, 1540 bp, Homo sapiens
gaagcaaacggcgctggtctattttaatcctgctccttctagaaactagaaactgcaagaatgggaactatgcaaaggcacctggctgacggtccagccagcgctgaaggaaatggcagtgtcaaggcaatagtttttaaatctctggaaacacccattaaaaaaagtcagagtaggataacaaagccaaaacaccatgtacggtatccacaacaaaaccaagtgaaaagatgtccctacaaatgccaagcattgagccatactaaccagactactatagtaaggaggaggcagaggggtaaaagaggtacttctgatgtactgactaacaatcccaaactgacaacagacagtcacttgaaagctcagcaagccaatctaaggagagcagtcaaatctgggtgggagcttagccgactagaattcccgggtaagactgatgtagccagagatgtctgggacctctgtactcttgatactaatcatccaaatctcccttcaagatgatttcaccaggaaggagaaacttctgtgagcagaatccaaattagttaggttagggaaaataggggcaaagaaaggagaaggagggaaaaaggaaaatgagcagagccagtggatctcaggaagtatgagagtatatgttttcaaaaacgcttgagaacaacagaaaagagagctctacagaatatagcatgaaatctatcctggttcatctttcctttctagcaaagaaaaacctgtttcacttaaaatgagcaacagaaaatgattgcaggcaaatcccacataaagtcactataagggggaaaaaaaaaaaccaggaccaacacaatattcatatagacaatcaaagaaatcagaagattatgtttacaaaatagatgaaaattataaactaatatttcagaagagatgaaaaataatatgaaataatgcaaatagagtaaaagaagctatgaaggaacacaaataagcttagagaaactcagaaatggtatgactgaagaaaagataagaaaaagaaaagctttgaaaaaggacctgtctaagcttagaaaataatgaaaattaaaacattatttcagaaataaagtctaaatgagaaggaacacaagcatgaataagcaacacacaaaattccttagataaataggagattgaagagagtgacacaactttaaatcagaaaggaattcaaaagagatgaaacagattagacagtgatacagaagctagacagggaagatccaatgcatgcataataggagttttcaaagaagaaaacaaagatatggaaaagaattaatattaaaaactataattcaatcaagctttcctgaaataaaaaaaaatatttcacacatattctaacaattaaatatcagtagttaaaaaaatcagtaggtaagacaaattcaggagggaaaagttattgttctgataaaaactaaattatacccactatccctttgaagaaggaaattccctctaatttcatattcccctcctcctttgatttgaagattctgttaaaaac

SEQ ID NO: 461796 - DNA, 3106 bp, Homo sapiens
aggcagagccaagtgcgtcctggaggcttcccccgttgcgaaggtctttcaggactgattttggtggaagaagacagcaggcggtgggcattcactgtgctggtgggaagtctggttacattaagaaaggaattctagcaaagttattctgtaaatacaacagaatcagttgcttttgttaaatatattggtgcaagttcaacatggaggcaaatcactgctccctgggtgtgtatccatcttacccagacctggtcatcgatgtcggagaagtgactctgggagaagaaaacagaaaaaagctacagaaaactcagagagaccaagagagggcgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtctccacctagtaaaattatgaaagctgtataccagaacatatctgagtcaaatcctgcatatgaagttttccaaactgacactattgaatatggtgaaatcctatcttttcttgagtctccatccatagagtttaaacagttctctacaaaacatatccaacaatatgtagaaaatataattccagagtacatctctgcatttgcaaacactgagggaggctatctttttattggagtggatgataagagtaggaaagtcctgggatgtgccaaagaacaggttgaccctgactctttgaaaaatgtaattgcaagagcaatttctaagttgcccattgttcatttttgctcttcaaaacctcgggtagagtacagcaccaaaatcgtagaagtgttttgtgggaaagagttgtatggctatctctgtgtgattaaagtgaaggcattctgttgtgtggtgttctcggaagctcccaagtcatggatggtgagggagaagtacatccgccccttgacaactgaggaatgggtagagaaaatgatggacgcagatccagagtttcctccagactttgctgaggcctttgagtctcagttgagtctatctgacagtccttcactttgcagaccagtgtattctaagaaaggtctggaacacaaagctgatctacaacaacatttatttccaggtactgactgccagtttttacatcaggagagaaggaagtcatttaatacatttcgtggaaaacaaatccatgaaagattgtgtcctgcagatccaggtgtacacagtgacaatgccacaagcctcttggggatgattccaccaggacatttggaatgtactccagagtccctctggaaggagctgtctttacagcatgaaggactaaaggagttaatacacaagcaaatgcgacctttctcccagggaattgtgatcctctctagaagctgggctgtggacctgaacttgcaggagaagccaggagtcatctgtgatgctctgctgatagcacagaacagcacccccattctctacaccattctcagggagcaggatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccgggaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgacctgcttcattaaagatctgaaaatctatccagccattgtaaaatgaaacaaaatgttttgaaaatttaaattagccttttattttagttcagacatatagaaaagttgcaagcatagtacagaaagttcctatataccccacttagtgccctcctttttaaaatttttttaaacctagcttatttcctttaagatttctgagaatt

SEQ ID NO: 461797 - DNA, 1313 bp, Homo sapiens
atctgcgaagccaaagtaaacaacggggttggggcggcgagaatgatcaatagcgatgctccgaaaggactccgcgataggaatcgagcgggaaggattccctccatcctaacagcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacagatctgtgaaaatctttaaaggcatgtgttttgccatatatgcaagtgaatcaacttgccagataaaagtttgctgcctaaatatgattactaggaaagccaagtctctcttcctggatttcttctcctataaaccgcctattgatacctacccacttctctatggagcacagatgaaggatattggtcatctccagcatctagcacaacgtctgcaatggaacaggcgagctgtgaatatttgtggaatgcatgggtggactaaagacctatcacctcactctagaatgcccagcatgttggagcatgttaagcactatatgagctgctgaggatacaggaataaacaacaacacaggtgtgtcctctgcccaaaccaggcataaatgagcttccaaatgaacacaaacaaatctggaaggcttttgaggaagaaggaccattaaaaaagctgctgacgactgcctggaatctggtttggagcatctccaaagccaacgtactttcccccaagaaaatacaggaagatctctctgcccaggcttggaaatacataaggatcaggtttgccatcctctactttagggtgactttaacataatttaatgcccactgactgcttttctcctacaggtaaagtaacaaacaaaggagtcaactctcaggagctctctctttcatctgctttatgttgccattttccctcattgccctctcacattcactcagtaattcaccaaatatttatagagacttcatggtgtgcaaggcagtgaactccacactgtaggaagagtaaagccatggagatcgcaggcctggctcttcatacctttggctttctgttgaattgaactttctgttaagtttaaaatacacaatagaactttgacgatgttgtggcctggtcagggatgggacagataaccagcccttaaaaataaagctcctccggccccgcccaataccttctgaaagaaggagggttattatagagcataaataaaacagtagtgattaataatgataataaagtttatctctttactca

SEQ ID NO: 461798 - DNA, 1226 bp, Homo sapiens
atctgcgaagccaaagtaaacaacggggttggggcggcgagaatgatcaatagcgatgctccgaaaggactccgcgataggaatcgagcgggaaggattccctccatcctaacagcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacattactaggaaagccaagtctctcttcctggatttcttctcctataaaccgcctattgatacctacccacttctctatggagcacagatgaaggatattggtcatctccagcatctagcacaacgtctgcaatggaacaggcgagctgtgaatatttgtggaatgcatgggtggactaaagacctatcacctcactctagaatgcccagcatgttggagcatgttaagcactatatgagctgctgaggatacaggaataaacaacaacacaggtgtgtcctctgcccaaaccaggcataaatgagcttccaaatgaacacaaacaaatctggaaggcttttgaggaagaaggaccattaaaaaagctgctgacgactgcctggaatctggtttggagcatctccaaagccaacgtactttcccccaagaaaatacaggaagatctctctgcccaggcttggaaatacataaggatcaggtttgccatcctctactttagggtgactttaacataatttaatgcccactgactgcttttctcctacaggtaaagtaacaaacaaaggagtcaactctcaggagctctctctttcatctgctttatgttgccattttccctcattgccctctcacattcactcagtaattcaccaaatatttatagagacttcatggtgtgcaaggcagtgaactccacactgtaggaagagtaaagccatggagatcgcaggcctggctcttcatacctttggctttctgttgaattgaactttctgttaagtttaaaatacacaatagaactttgacgatgttgtggcctggtcagggatgggacagataaccagcccttaaaaataaagctcctccggccccgcccaataccttctgaaagaaggagggttattatagagcataaataaaacagtagtgattaataatgataataaagtttatctctttactca

SEQ ID NO: 461799 - DNA, 728 bp, Homo sapiens
atctgcgaagccaaagtaaacaacggggttggggcggcgagaatgatcaatagcgatgctccgaaaggactccgcgataggaatcgagcgggaaggattccctccatcctaacagcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacattactaggaaagccaagtctctcttcctggatttcttctcctataaaccgcctattgatacctacccacttctctatggagcacagatgaaggatattggtcatctccagcatctagcacaacgtctgcaatggaacaggcgagctgtgaatatttgtggaatgcatgggtggactaaagacctatcacctcactctagaatgcccagcatgttggagcatgttaagcactatatgagctgctgaggatacaggaataaacaacaacacaggtgtgtcctctgcccaaaccaggcataaatgagcttccaaatgaacacaaacaaatctggaaggcttttgaggaagaaggaccattaaaaaaggtacagaaagaatgtattgagatcatgtttatccatcactgaaataaaatacgctccaaaatttcaatgattctccagccaatatattattacccctcctta

SEQ ID NO: 461800 - DNA, 1104 bp, Homo sapiens
cttagactcagccgttgacaatttcttcctcagccctccccctggaaggtgttacgccccttctccaggtgggggacactaaggttcagagagctcgccctgcagcctacaggggtcacctctcacattctactctccagcgtatgacaaccctggacgaaaggggctgagaccaagaaacagtatcagaggctgaacccctcggcgatgagcgtctgtcccaggacttggaagggagggagggagcatggccacggcagctgcctgcagtattacagttccaaaacataacttgaaggtcagcacaggagctgctgtgatataaaaggagagagtcacctggcgccccctgcagtcctccagttgcccagcagcggtgggacgctcagtggcacacactgggtctctgtatggcctcccacctgcaaggacttccccgggcaggcccagctgcccagaagccccggaacacacaggaagacaacactataggatggcaggtggggatctgtgcaatacaaacatgtagctagaaaacccaactgaggatctgtctagaatacttccgatatcaatataccgtagttgttgaaaccagaaccgtctccagccgtcagcagtcttggcggctactgtacagctgtcagcatgactacaggcagcacccgaggctatctggggggccacgggctgggtgttggggtgaaggttcagaggaggaacagcagcttggggcagcccctgtcagaagggccccctgccatggcagccagtggaggccagggaccttcagggcactggaggggacagagcagctctttcctcagtgacccgagggaggggaagtggcagctggtgctggcccacgggcccagccccattcctgctgcacctcctcagcagccaccccccaggctgacagctgtcgtttcacgatgggctgaggggtggggtggggggtttccaacacttgattcgagcggactgcaacgcccagctcacaggacaactgaaggagtcagacctcaaattgctgttctcaaagacaatgacaacacccatttttgatgcctgaaaagaggcaaaggcttctggctaaatata

SEQ ID NO: 461801 - DNA, 745 bp, Homo sapiens
ctcccttcctggacaacaagctccctgaggacgtgggcgacttagtacatcttgtatgggcctctctgcctgttctttgctttgctttctgggacacccttaggctagtctagcaattctgaactgcctggcttgaagagttgattcccatgggatgttgaggaggggccagaggttctggaagaatagtaaaaaacctacaaccaagtggtagcatctcagtattcctcttccacaaagtagcccatccccccccatcaccaagggaagcccctagtggtggcaggcatcttgggaatttaccttcattactaattctcccttgtctaccagtagcacttcttaacctgctcactgcccatcagaacagcctccgacaaagctgcatccaaattctttaaagggcaattcattgccccaagtaatctgccaaacctgtcttcatttggaaatcagtcttcatattcagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacggagatgcggccaaacccttcccctcttcccccccacacaccaaccacccc

SEQ ID NO: 461802 - DNA, 712 bp, Homo sapiens
tgtgtccagtgagcagttgaaaatagggttttggagtatttaatggacagaagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacaggaaagcatggctaacaacgggttgtcgaaaacttccttattagataatccggtgatagacaataggagtaagatggtaaggatagtcacaaggacaatagctgtcactaaccagcagcactgttctgacacttacaatgtatgtattaacttactgactctcaccacagccttatccatacctgtgctcaacaaaaacgtgacaaccccagaaagaatgcctgtgacgtgctttgctggccccagcagcacagcggtgagcaagagacccagtgccactggtgggggaggcaggtgtccttcaaaccatcgcccaccagagacaaaactgcagagacctgggcaaggagagtgcggtcagggaaagctctcctgggggatttttgaatttgtgatgatcctgtctttgacaagaactggctaatctggttgc

SEQ ID NO: 461803 - DNA, 442 bp, Homo sapiens
aaatttccaaaatacatttcatcaacttatgcatttagaaacaagaaaaaaatatatctaacatagtttttttgtaaaacgccatttcaactctgagtagtgggggagggaatcacaggataaagtacagttctttaaaagaaattagttttgctttataaaagtcactatgttgtcctcagttttctctcattgctgcttatttttctccacacagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaac

SEQ ID NO: 461804 - DNA, 1380 bp, Homo sapiens
ctcccttcctggacaacaagctccctgaggacgtgggcgacttagtacatcttgtatgggcctctctgcctgttctttgctttgctttctgggacacccttaggctagtctagcaattctgaactgcctggcttgaagagttgattcccatgggatgttgaggaggggccagaggttctggaagaatagtaaaaaacctacaaccaagtggtagcatctcagtattcctcttccacaaagtagcccatccccccccatcaccaagggaagcccctagtggtggcaggcatcttgggaatttaccttcattactaattctcccttgtctaccagtagcacttcttaacctgctcactgcccatcagaacagcctccgacaaagctgcatccaaattctttaaagggcaattcattgccccaagtaatctgccaaacctgtcttcatttggaaatcagtcttcatattcagaaccagccgggcgcggtggctcacgcgtgtaatcccaacactggaaggccaaggcaggcggatcacttgaagtcgggagtttgggaaacatggtgaaaccccatctctactaaaaatacaaaaattagccggccatggtggcttatgcctatagtcccagctaccaggaggctgaagcaagagaatcacttgaacccgggaggtggaggtttcagtgagctgagattgcacttctgcactacagcctgggagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacaggaaagcatggctaacaacgggttgtcgaaaacttccttattagataatccggtgatagacaataggagtaagatggtaaggatagtcacaaggacaatagctgtcactaaccagcagcactgttctgacacttacaatgtatgtattaacttactgactctcaccacagccttatccatacctgtgctcaacaaaaacgtgacaaccccagaaagaatgcctgtgacgtgctttgctggccccagcagcacagcggtgagcaagagacccagtgccactggtgggggaggcaggtgtccttcaaaccatcgcccaccagagacaaaactgcagagacctgggcaaggagagtgcggtcagggaaagctctcctgggggatttttgaatttgtgatgatcctgtctttgacaagaactggctaatctggttgc

SEQ ID NO: 461805 - DNA, 8151 bp, Homo sapiens
  misc_feature (151)..(151): n is a, c, g, or t
  misc_feature (153)..(155): n is a, c, g, or t
  misc_feature (157)..(158): n is a, c, g, or t
  misc_feature (161)..(162): n is a, c, g, or t
gtcccccagccccacgcgtccccatgcagccctggcagtgcctccggcgctttgccctggcctggtgggagaggacggcggagggcagagcccgctctcccagggaggaggctggaccgagggaccctgggggccgaggggagccagggancnnncnnggnnaaagatgacatcatgtgtgaatgttgcccaggggcagccagaggacagagtagagggttacatccgggatccggagcggagcagcccccccatgctgtctgcggacgatgcggagtacccgcgggagtaccggaccctggggggcgggggcggcgggggcagcgggggccggcgattctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcaggccggcgtatcgggtgaccgcggcgacgcagccaccagcctccgccgctcctctgcggggctgcgccggcggggccgcgccgagggagggggccgcgagaggggatgtgcacggcggcgcgcagcgccgcgccaggtggagtcgcggttaccggggcgactggggcccgggccggcacggcggcggccgcggcggctctcgcattgcagcaaagggcaccggcggcggcggccgcggctgcggaggcggccgggggagagaagagcccgggcgggtgggagtaggggccctccctccccagccggacgcaggacctggggctggggaccccgcacgtacacctgtggccgcagtaagggggagcgactgtgggggccgggatcgccgcctcgggttgggcggggggcggggacacggagatgggggcccgctccgcggcaccgagagccatccaggggtgggggacgtccaggccattgcaggctttgcaccggggtgcgcatctgcacggacaccttctggtatgggcggtgggcctcggggctgcaggctgtggctgctgctttgggagagtctggctgggatgaaggtgagacagaggggtgtgggctggcactggtggtcagcctagagctgagccatagcctctcggtcacaagcacaagcggcccctccctactgcccctggcccatttctatgctgccttcctcctgccaagacccacacccacccagtggaccttcccaggcctggatatgggcagtgacaagcaaaggggggggggggtgctcatccttggttcctctcaccctgcccggcccctgcagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccagctcacttcccctcagtttccgccccacctgctctgcccccacttccatttccttgtccaagttccttcaactgcctggagtccagtgggtgccttgagaggctggagagccggcctggcgcccccgccggcagcatgagaggtgcctgggtgcatctgcactcgggggcggcgtctagcctcagaccctgccgctgcggggctggcgcagctccgaaaagctccccgcgctctcctggagggcggcgtggagacggcagcagtgacagcgagggcggcgtctccttcgcaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgatttggctgtacagagaccccctgacttgggaggggaggggggagtggtgccccctcctccctccactccattactctctgcttgctacttcgcttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctctcctggatctccttcctataggctgatg

SEQ ID NO: 461806 - DNA, 854 bp, Homo sapiens
  misc_feature (851)..(851): n is a, c, g, or t
  misc_feature (853)..(853): n is a, c, g, or t
aacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagaagattattgaaaatgtcagtacgagtcaaaagagccaaatgcaggctcaaacttcagaacctaataaaagttatactacagaaataataaaaaacccacacatcacacagctgctgaccatgatcaaacctaacggccaacaccagagtcctgtgaataagtcctgcttcctacttgttctcttaaatcagcctaagccacacccccacgggaaagccccaggacaaagctccaggccctaactgtgctctctggctccccgtggcctccagacttcccctcgggctcctgccgctctctggacctctctgggatgtgtnant

SEQ ID NO: 461807 - DNA, 1315 bp, Homo sapiens
agacacaactccctctaactcccactctttgactctgcaaatgggccacccacttcttcattttcatcttcctgagcgttctgtggggaaactcaaattcggataatctgggatcttgctcagctccattgctgagaagtactgtggagcaggctgacgaggagagatgggcatcagcggggcagggaaggccagagacccccgaatcttcttcatggatgtcagcttcagcatccatgcccccaccctctgtttctgcagtttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaagtggtccctggcctgcctagaaggcagccacactttacattctcctatccccttagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctcggtgcggatcctccaagatgagcaatacctgatggcttcagacatggctggaaaggtaggggatcatggactttctcaggccacagggtctcgtggcccagtgccctgccagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcctcgcggctggggggctcccggggcgcgccggggctgctcatggctgtcgggcaggacctttactgttactcctacagctaattctgcagggca

SEQ ID NO: 461808 - DNA, 1109 bp, Homo sapiens
atggagttggcgtcggagcaacagctgcgcgggcggagcagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggagatcccgatcaggagcatcagtctgagaagctgctatttcagtgacccagactgttcaatgagacccactctgatagatctcctgcccaccttccggcacactctgcagaagaaagcccactgctgcctgctcttggctaggctcccaaatgttcactcaatctcaaattgaagttct

SEQ ID NO: 461809 - DNA, 1058 bp, Homo sapiens
  misc_feature (494)..(494): n is a, c, g, or t
  misc_feature (498)..(502): n is a, c, g, or t
cccccttctggttctgcaatgagtagttacattgttcctcagagtgctgaattttgagagcaaagcattacagaaatgtaaaaaaatcttgaaggccaggtgcggtgtctcatgcctgtaatcccagcactttgggaggctgagatggagtctcgctgtgtcaccaggctggagtacagtagtgtgatctcggctcattgcaacctccatctcccaggttcaagcaatcctcctgcctcagcctcctgagtagctgggactacagaaaacaagctcatattaccaagtgtgaaattacagcaagtcttacaggctgggaactggaaaagagcttccccatcatggtggattatacaaccagtggtggagagtaactccaaaatatagcatctttctactcatcttactaaagctcaaagaaggtgatctacaagataatgaaaacaaggctcaaaataaaaacaagaaatctttatgaaattacacaaagtgtncagnnnnnaatcagaaaacgtttgaatctgcctatgacctggaagtctccacttccaattgtcccacctttccaggtggaaccaatgttttattattacttagatatagtaataacaacacatcagatgactgccattgaaaagatggcttgctattcacagttcccaagaggagagagcatgccacaccacagggggccacatgagaaagcatctgggttacttaggcagcagaaagaaagggaaaatgtgggcaaggacctttattgtggtttccatgggaagaaacaggcaagggcaatgaaaatgtcctggaatcagctagcaatcgtggttgcacaattttgtgaatatactttaaaaatctgaattgttcacttcaacagggtgaattttgtgatatgtaaatttatctcaaaaaaaagaaaaaaagttacgttagtcatgagaaaaactgttctgtgaaaaaaaaaattccctttaattcagaagaactgattttagcagaatacattttggacaaaatcatttttaaaattttcctacagtcaaagaaaggaatat

SEQ ID NO: 461810 - DNA, 3056 bp, Homo sapiens
acagtgacggtggccgtaggcactattttaaattgggtgaccaaggaagcctttctaatgaggcatcatttgagcagatatctaaagggcactgtaactctagacagatccaataaaggttttcataactgctaccaagtcagggaggagtcagacatcatcagcctcagccaggagccggacgaacatccaggcgacatatttttcaagcagactcccacgaaagacattctaactgagctgtacaaactcacaacagagagggagagactgctaaccaatctcctgagctcagaccacatcctggggatcacgatggggaaccaggaggggaagctgcaagagctgtccgtgagcctggcccccgaggatgactgtttccagagtgctggtgactggcagggagagctccccgtgggccctctcaataagaggagcacccacgggaacaaaaagcctcggaggtctagtggaaggagagagagctttggggcccttccacagaagaggaccaaaagaaaagggcgtggaggccgagaatcagctcctctgatgggcaaggacaagatctgttccagccactcccttcctctttctagaacaaggcctaacctttgggtactagaggagaaaggaaatctgctcccgaatggggcacttgcctgctccctgcagaggagagagagctgccccccagatattcccaagacgccagacacagaccttggctttgggagctttgagacggctttcaaggacactgggcttggaagagaagtgctgccccctgactgcagctccacagaggcaggaggggatggcattcggaggccgccgagcgggctggagcatcagcaaacaggtttgtctgaaagtcaccaggaccctgagaagcatccagaggcagaaaaggatgagatggagaagccggctaagcggacttgcaagcagaaacctgtctccaaagtggtggccaaagttcaggacctgtcctcccaggtacaaagagtagttaaaacgcattctaagggtaaggagacgattgccattcgcccagcagcccacgctgagtttgtacccaaagccgacttgctcaccctcccgggagctgaggctggggctcatggctccaggcggcagggcaaggagcggcaaggggataggtcatcgcagtcgccagccggggaaacagcctccatttctagtgtgtcggccagtgccgagggggccgtgaacaaggtccccctgaaggtgatagagagtgagaagttagatgaagcccctgaggggaaaagactgggcttccctgtccacacgagtgtccctcacactcgcccagaaacgagaaacaagaggagagccgggttgccccttggtggccacaagtccttgtttctggatctgccccacaaagtaggtcctgactcctcacaacccagaggtgataagaagaagccatccccaccagcaccggcagctcttggcaaggtgtttaataattcagcctcgcagtccagcacacacaaacagacgtcacctgttccctcgcctctgtctccaaggctccccagccctcagcagcatcacaggatcctccggctccctgcattgcctggtgagagggaagctgctcttaatgactctccttgtagaaagagccgtgtcttctctgggtgcgtctctgctgacaccttggagccaccatcctctgcaaaggtcacggagaccaaaggagccagcccggccttcctcagagcaggccaacctcggttggtgcctggggaaactttggaaaagagcttggggccagggaagaccacagctgagccccagcaccagtcacctccagccttccattgggatcttcagcagcactttcaggaaccagtcataagaactgtaagcatctcctgtgcttctaaccttataaaagaagaagctggaaaagggaaggagagtagaagtggaaaccaacggaagaaagcaattcagagaggcccctggattactcacagtcctgagaggaaacagatacctgcaaggctgaaggcgcaagggaaggcgtgcgtggtcactggagcccagacaggggagattaatggaggggaccctctgtcaggaacagtggtttctggtagagacacccagcggagaggaagctgtggggataaatatcctggcctcaccctcctctggaccacttcctgtaaacctcctctaactgaaccaaccagaaagcagagtgtaaaggagccaagccaggggctgtggtctacggggtcagccttccatggccaagagcaggttgagaaaaatggggagtggatctggaggagccaatgggagtctggatgagggggatgaattatgccataaagaacaggaaaatactgttgcttctaaccctctttgagggagttacttcggtagaatgacgtctatgagtagattataagaggctgaagatgctgttaccctattttgctagaaaatgctttttttatttttaactaaccttgaaactattcatctctgcatgggtttgggaatctaaatgtactcagagataaatatatatagctacccttctcattcaaggtaggcagagggaactctggaatgcttctaaaactcctaccctggcctcttaagtagaagaggcaaatgtagaagaggtgctttgctactgagtgcaggcaacagtgaaggtcccatggcaacagggaatggggaaaggcaagggtggcatgggctgaaagccagctgtgaataagaaccaccaatttcatgagccaagattgcgccactgcactctaccctggcgacagagcaagactatctaaaaaacaaaacaaacaaaacaaaaccaacttgtcaactatgtactttactgggaaatggtgtaatagacaaatgatttctacctttgtatcatatagaactacatgtaatactggaaatgagggaatgagtttctccctttgtgctctcaatttatagacagtccagaacattgtaaacaatattgacactggcattgaatgtgaccctgaatc

SEQ ID NO: 461811 - DNA, 966 bp, Homo sapiens
ctcacagtctttttgagaagaagcttgtgcctgtgcctggaagcaaggagggctggaactggggccctgctgggaagccctgtatctgcagaactgtgtcccgtgggggccaggggacacagatttttgcagccctctgatgctgaagcctttctggggctgggatgacccaatgcccacctggaccgtgcacttcctggtgaccctctgagacaacttcctgggcagagttgatcatcatggagtcagtgcaagtctgggaacagtggcctgaaactgcgcagctccagtgtgtcggtggaggcccttcagtgaggagtcccccagtctgggtggagagccagcccgatcggcttgattcctccactcttgacaccgtgagcctcagattctgagagcttgggaggatggacagagactgcggtcagcaggagaatgggaagcagatgggagaggaagaagcttgcctttggtggggaccaggaggctgggagcccaggcccattcactgtaacatgtgcagtaaatcccattatattcatgcaaagaattctacacagcaaggaaaaggaaagagctgttggcatgccacaacacaggtggatctcacagacctactgctgagctaaagaaggcaaccacgcacatgtacatgctgcatggggccgtttctatctgcccagaaccaggcaagaaccatctatgccaacagcttcattgctgctgtttctggggttgttgactggaggggcgaggggaccctctcggatgtggaaatgttctgtgatgagatagaggtttcctgcatgtctgtgcctgtgagatgcatccagctgcacacttcagatgcgtgcattttattgcatatgttatgccttgatttttaaaagtctttaaatatttaatcctgaacatccctacgaaacaaataataaaacagccctaggctcctgatgtcttgcccag

SEQ ID NO: 461812 - DNA, 878 bp, Homo sapiens
caggggaccggcaggtgcgtgacatccaggagggaaagccatgcactgcggaggtttaaagaaggcgggaataaactctgcgacttttggtttagaaaacacactgtattcagaggcagccagagatgatttataacatgccatattagggaacttataatagcatctaacaagcaaaacctccgcatttcagtggcttcatgtaacaccgttaattcttgcttcctgaacagctccatgtggtgcttctggtgggcaggtggccctcttcctggctgactcagggacccctgtggctctgctgttcagggagagtcagagccctctgtgtgcagctggcaaagaaggaaagtggccagggggatggcccagccctatctcagaaacctcagcccggaagtggcccacttcccttccactcacagtctttttgagaagaagcttgtgcctgtgcctggaagcaaggagggctggaactggggccctgctgggaagccctgtatctgcagaactgtgtcccgtgggggccaggggacacagatttttgcagccctctgatgctgaagcctttctggggctgggatgacccaatgcccacctggaccgtgcacttcctggtgaccctctgagacaacttcctgggcagagttgatcatcatggagtcagtgcaagtctgggaacagtggcctgaaactgcgcagctccagtgtgtcggtgagcgccgtcctcccagggctcaggggagggcagatgagaaaccagaagatccgcagagcaggaggctccaccggaggcccgagccagggccacccagaggaacgggccctggctggggacagaagcctgctggtgtgctcactgcgtttccttccccttt

SEQ ID NO: 461813 - DNA, 1701 bp, Homo sapiens
ctcacagtctttttgagaagaagcttgtgcctgtgcctggaagcaaggagggctggaactggggccctgctgggaagccctgtatctgcagaactgtgtcccgtgggggccaggggacacagatttttgcagccctctgatgctgaagcctttctggggctgggatgacccaatgcccacctggaccgtgcacttcctggtgaccctctgagacaacttcctgggcagagttgatcatcatggagtcagtgcaagtctgggaacagtggcctgaaactgcgcagctccagtgtgtcggtggaggcccttcagtgaggagtcccccagtctgggtggagagccagcccgatcggcttgattcctccactcttgacaccgtgagcctcagattctgagagcttgggaggatggacagagactgcggtcagcaggagaatgggaagcagatgggagaggaagaagcttgcctttggtggggaccaggaggctgggagcccaggcccattcactgtaacatgtgcagtaaatcccattatattcatgcaaagaattctacacagcaaggaaaaggaaagagctgttggcatgccacaacacaggtggatctcacagacctactgctgagctaaagaaggcaaccacgcacatgtacatgctgcatggggccgtttctatctgcccagaaccaggcaagaaccatctatgccaacagcttcattgctgctgtttctggggttgttgactggaggggcgaggggaccctctcggatgtggaaatgttctgtgatgagatagaggtttcctgcatgtctgtgcctgtgagatgcatccagctgcacacttcagatgcgtgcattttattgcatatgttatgccttgatttttaaaagtctttaaatatttaatcctgaacatccctacgaaacaaataataaaacagccctaggctcctgatgtcttgcccaggatgcgcagagccaagggggtttccaatcctgctccttgctgaccagggcctctgcatcatgacactgaccgtcccacacatctggctgccgcctcctcgctattacctcatgtcttcctctgcaggctcccagactggggtcctaagatctggagatgctgcctgcagtctgcagaggcgaagtctggccaacacacgcagctgccctcctgaacagaatatcgtcagcctcaacatcagcatcggggttccctccttacacaggggtccccccttatcggggggggtgcattccaagacccccagtggaagcctgaaacttgggaagggcgcctacagtgtggagacgctggacaaagggggacgcgtgtccagggtgggaagtgtgaccctgctgcgcgtcccctctgcccaccctcctcctgcctccggcccagtcgctggttcccaaggaaacctctctaaagtcgtggccagtgaaaccacagcgccctaccaggccccatccctggacccatcctgccatctccccgccgtctgcccagggacccatggctcctccccagctgctcctcagcacccgggtctggggcacgtgtctgcagcgtctcggaacccggttctgttgctcaccataaagctctgccgagcgccctcaggaaacagaagccccaaagaaaggggcttgtaggacagtatgcatggagcccctggcctgggctcatagcccccat

SEQ ID NO: 461814 - DNA, 2261 bp, Homo sapiens
cagagtcggccctgtgctcgccaccgtcacctgctggttggattccggaaacccactgtctgaagaccacagagggactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccctggcatcctggttcatatctgtgttgctgactacagtgtctgtgatgtccgcatgtccaggcctgtttgggatgaggtgtccatgaacaaagtcacagagaagactcacagagtcctgagggtcatggaaatcaaagaggctgtctcctcactcccttcatattggagttggcttcgaaagaccaagctccctgagtacaccagggaagggggcagcaccacgctgtacaactgctccacctgcaaggggacggaggtgtcctgctggccccgaaagcgctgcttcccaggtcctcacgcccatcttggccccgccccaccttgcccagatccctgagcccttgggctcccaagtcggtgcgtgtgggtcccagaatcattcactgcctcctgggttccctgcaggaagtcaggatctttgggaagccaagattctgctcctctccatcttcggagctttcctgcttctgggtgttctgagcctcctggtggagtgagttttgggataaagacaggaatcctaccccgcccagtgccttccaccacccatcctccctccctctgtccctcccaggcccctcccgtaggcttcccaccctcgtcttccctcaggtcccaccacctccaagcaaaaagtggcttgtgaagacgctgaaaacctcccagcctccagctctaagggccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatggcctctgcccctgcctagcctctgtctgcaactggggagggcagaggaaggatgggagactctcagagtagcacagtgcttctcagatgggggtgattttgcaccccagtagacattttgcaacatctggagtcgttttggattgttttaactggggggacgtgctactggcctctggtgggtagaggctagagatgttgctaaacatcccacaacacacaggaaagtccccacagcaaagaattatcccgtccaaaatgtcagtgtttaccaggaaagggagataggagaaaaaaaaaaagaaaagaagaaaaagaagaaggaggaggaggagaagaagaagaagaagaagaagaagaggaagaagaagaagaaagaaagaaaagaaagaaacaaaatgtcagagcatggttgagaaaccctggtgttttgtcccctgcctatcaggagtttttggtttgggaatggaacgtgggacatgg

SEQ ID NO: 461815 - DNA, 2486 bp, Homo sapiens
cagagtcggccctgtgctcgccaccgtcacctgctggttggattccggaaacccactgtctgaagaccacagagggactctatgctgggggccatgtttagggccggcacccccatgccccccaacctcaattcccaaggaggcggccactacttcatcgaccgggatggcaaggccttccggcacatcctcaatttcctgaggctgggccgcctggacctgccccgtgggtacggagagacagcgctgctcagggcagaggctgacttctaccagatccggcccctcctggacgcgctgcgggaactggaggcctctcaggggacccctgcacccacagctgccctgctccacgcagatgtagatgtcagcccccgcctggtgcacttctctgctcgccggggaccccatcactatgagctgagctccgtccaggtggacaccttccgagccaaccttttctgcaccgactctgagtgtctaggtgctttgcgggcccgatttggtgtggccagtggggatagggcagaggggagcccacattttcatctggagtgggccccccgccccgtggaactccccgaggtggagtatgggagactggggctgcagccgctgtggactggggggccaggagagcggcgggaggtggtgggcaccccaagcttcctggaggaggtgctgcgggtggctctcgagcacggcttccgactagactctgtcttccccgaccccgaagacctgctcaactccaggtctctgcgctttgtccctggcatcctggttcatatctgtgttgctgactacagtgtctgtgatgtccgcatgtccaggcctgtttgggatgaggtgtccatgaacaaagtcacagagaagactcacagagtcctgagggtcatggaaatcaaagaggctgtctcctcactcccttcatattggagttggcttcgaaagaccaagctccctgagtacaccagggaagggggcagcaccacgctgtacaactgctccacctgcaaggggacggaggtgtcctgctggccccgaaagcgctgcttcccaggtcctcacgcccatcttggccccgccccaccttgcccagatccctgagcccttgggctcccaagtcggtgcgtgtgggtcccagaatcattcactgcctcctgggttccctgcaggaagtcaggatctttgggaagccaagattctgctcctctccatcttcggagctttcctgcttctgggtgttctgagcctcctggtggagtgagttttgggataaagacaggaatcctaccccgcccagtgccttccaccacccatcctccctccctctgtccctcccaggcccctcccgtaggcttcccaccctcgtcttccctcaggtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatggcctctgcccctgcctagcctctgtctgcaactggggagggcagaggaaggatgggagactctcagagtagcacagtgcttctcagatgggggtgattttgcaccccagtagacattttgcaacatctggagtcgttttggattgttttaactggggggacgtgctactggcctctggtgggtagaggctagagatgttgctaaacatcccacaacacacaggaaagtccccacagcaaagaattatcccgtccaaaatgtcagtgtttaccaggaaagggagataggagaaaaaaaaaaagaaaagaagaaaaagaagaaggaggaggaggagaagaagaagaagaagaagaagaagaggaagaagaagaagaaagaaagaaaagaaagaaacaaaatgtcagagcatggttgagaaaccctggtgttttgtcccctgcctatcaggagtttttggtttgggaatggaacgtgggacatgg

SEQ ID NO: 461816 - DNA, 914 bp, Homo sapiens
  misc_feature (1)..(1): n is a, c, g, or t
  misc_feature (3)..(3): n is a, c, g, or t
  misc_feature (8)..(8): n is a, c, g, or t
  misc_feature (13)..(13): n is a, c, g, or t
ncnttggntccanggcccagatattcactattaagtgtccaggaaggatctttcttatataaaggtgcttctgaggacttccagagttacaatggaggaggaatcgggggaggaactggggctggacaggtctactcccaaggatttccacttttaccacatggacctgtatgactctgaagacagactgcacctctttccagaagagaacactaggatgaggaaagtagtccaagctgaaatggccaatgagtcaagaggagcaggggatggtaaggctcaaagagaccttcaagaggaagtggatgaacttgtccacttatatggacttgaagatgatcatgaattaggggatgagtttgttgatgaaaacatacccagaacaggggtttcagaatatcctccttatatgatgaagaggagagacccagccagggagcagagagactggagacttagtggagaggcagcggaggccgaggacctgggcttcggagggtggggctcagcaggccagtgccaggacttgcgggaagcctataggtacacacacggccgtgccagcgaggagtatgaatgctatgtcatccccgaggaagaggatgaagaagaagctgctgatgtcttctgtgtcacttgtaagactccaataagagcttttcagaaggtttttgatgaacataaggagcatgaagtgatcccactcaatgaagcactggaaagtgccaaggatgaaattcacaaaaacatgtacaaattggaaaagcagataattgagatggaaaactttgcaaatcatttggaggaggttttcatcactgtggaggtaagagcacacttgaagacctcatcagactcacatttcttccatcaatggctatgtcaagcagctgtttctggtatgagctagagaa

SEQ ID NO: 461817 - DNA, 1750 bp, Homo sapiens
cttgttttctggtcacttttcatcatgtcccttcagctcctatctctaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccaggttgaggaaggaggattggcaataaggatacctttggcttgggtggcaggaaggttttattgtatctttgggattagggacaagattaaaagtcttcaaatttcaacatctctgccatcacattcttctaattttaacttgttttaaaataaactcagttatatggcaatgtattaaattgctatcaatgcatttttactgttaattttccttccaagtatagagtgtttcagcagcatcaagagttaattttacaatttgtatctgacctaggaatctaaccacaatatgtaaccacaatatctaatgttctgtattgggaatgcaggatcagttctaagtagacgtttggtatactgtgcattagttagcttgagtctctcccatgccaaattaagagcgtgatttttgttttctaacattattccatagtatgtgaggaactgccctctccagcaagtacatcatcacctgtctcccagagttgtcctcttcgtgaatatattaacttcaaaattcagccactgagatatcaccttccaggtaatttaattctggcttccgtggagttgttggtgtaactgtgttcaaacctccttctcttcaaaccagctctgtcttgat

SEQ ID NO: 461818 - DNA, 2153 bp, Homo sapiens
cttgttttctggtcacttttcatcatgtcccttcagctcctatctctaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccaggttgaggaaggaggattggcaataaggatacctttggcttgggtggcaggaaggttttattgtatctttgggattagggacaagattaaaagtcttcaaatttcaacatctctgccatcacattcttctaattttaacttgttttaaaataaactcagttatatggcaatgtattaaattgctatcaatgcatttttactgttaattttccttccaagtatagagtgtttcagcagcatcaagagttaattttacaatttgtatctgacctaggaatctaaccacaatatgtaaccacaatatctaatgttctgtattgggaatgcaggatcagttctaagtagacgtttggtatactgtgcattagttagcttgagtctctcccatgccaaattaagagcgtgatttttgttttctaacattattccatagtatgtgaggaactgccctctccagcaagtacatcatcacctgtctcccagagttgtcctcttcgtgaatatattaacttcaaaattcagccactgagatatcaccttccagattagataaagaaaatgtggtacatatacaccatgggctactacacagccataaaaaagaacaagatcatgtcttttgcaggaacatggatggaactggaggccattacccttagcaaactaacttaagaacagaaaaccaagtccagcatcttctcactgataaatgggagctaaacgaaagaacttatgaacacaaagaaggaaacagcagacactggggtctatttgagggggggagggtgggaggagggagaggagcagaaaagttaactattgggtatgggcttaatacctgggtgatgaaataatatgtataacaaaaccccatgacacatgtttacctgtgtaatgagccttcacatgcgcccccaaacctaaaataaaaattaacaaaaattttatctacatataattcagttggttattttttttctctccctgtgctatagtttggatgtttggtcccctccaaaccccatgtc

SEQ ID NO: 461819 - DNA, 2072 bp, Homo sapiens
cttgttttctggtcacttttcatcatgtcccttcagctcctatctctaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccaggttgaggaaggaggattggcaataaggatacctttggcttgggtggcaggaaggttttattgtatctttgggattagggacaagattaaaagtcttcaaatttcaacatctctgccatcacattcttctaattttaacttgttttaaaataaactcagttatatggcaatgtattaaattgctatcaatgcatttttactgttaattttccttccaagtatagagtgtttcagcagcatcaagagttaattttacaatttgtatctgacctaggaatctaaccacaatatgtaaccacaatatctaatgttctgtattgggaatgcaggatcagttctaagtagacgtttggtatactgtgcattagttagcttgagtctctcccatgccaaattaagagcgtgatttttgttttctaacattattccatagtatgtgaggaactgccctctccagcaagtacatcatcacctgtctcccagagttgtcctcttcgtgaatatattaacttcaaaattcagccactgagatatcaccttccaggaacatggatggaactggaggccattacccttagcaaactaacttaagaacagaaaaccaagtccagcatcttctcactgataaatgggagctaaacgaaagaacttatgaacacaaagaaggaaacagcagacactggggtctatttgagggggggagggtgggaggagggagaggagcagaaaagttaactattgggtatgggcttaatacctgggtgatgaaataatatgtataacaaaaccccatgacacatgtttacctgtgtaatgagccttcacatgcgcccccaaacctaaaataaaaattaacaaaaattttatctacatataattcagttggttattttttttctctccctgtgctatagtttggatgtttggtcccctccaaaccccatgtc

SEQ ID NO: 461820 - DNA, 1672 bp, Homo sapiens
cggagaccgtccgcaggggggatgagtctctatgatcgtaatgctttcaggcatgtttggggtgggcatggggattggggggaggaagagaagaaaaccagagtggagaagcagacggggtcagaggactgggagaaaaatgcctccatttactggagcttcaccacggaacaagtaaatggcttggggaccttggagtgggtgtggccctggggaattactcaacctctcttccgagccttttacttcccctcttctataaagtcaagaaataatgacaagaacggaggcagattcgtcagtcaccactatcctgcccctcccctcctctttgtccacgtagagcgccccctgggcctgaggtgcccacctcctgtctgaccaggtgcctggggccactcaacctggagcatgagttctgactggaccaagccagttccggggggctcttcccccttgccagtgattggttcaggcaaaggcatgttctacatctctggccaataagccatgagaagacatctgcagggggctctgggagaggctgtctctggagggtggggcccatgaacaggaagctgtcccctccctgcttcccctgctggagaagggatgccctcttgggtcaacgctgggaagctcaatggaaggggattgggtcctagctggtgcctctgagcccctgaggaaccagccctggagctgccctaccttggacccttgtgttataaggaagaatacacttgcctcagcatgtgaggcaccaggaagtacagaggcccatcccaggtcatagagccggcaagctggaaatctgggagttgacctctgacccgttcagacactgagtccttgatcccaaagccctcctgcctcccaaaccatctagcagcctcaagaagcagagaggaacttgcttccaaatcacaagattttgggggcagggctcaggaggagctggggctcctgggttccgggctggtccccttgcactctatttgtttactcacccagtcggttaagtaacactgtgcccctgttacacactataaacccagtactgtgtaccagtacaacaccctgtgttggaggcagagggctgcagaaacccagcatctgtcctcatgccaaaagaatcacagaaataaatgctcctccctgctccttgagtgcagggtgggaaccaagagagcttgggctaaaaggctaagttttcctacacatctggagtttctttctacccaacgttgcaatgcccctcacctggtaagtgcaccctgattttcctctggggagctgctcctccccattctctgtgatttgggtggactgccgctgaggatgggcacctgaccaggcctggccaagtggagactcatccattccaagcataattctttacatcaactgggaaaatagcaagcatcgttgaaacatttaatagatgctgggaagacatttgatacaatttaccatctggtcttgaataagactctaacaaaaggagaacggagcggagagggggtggtctttattaatatgcaaaagaatattgacctaaacctaagtactgacaaggtacttaatggtaggaagctactgtctctccactgtaaaaaattataaggaaaggatgatggggtcctgcctccaccatcccttaccaaccctt

SEQ ID NO: 461821 - DNA, 5029 bp, Homo sapiens
  misc_feature (3)..(3): n is a, c, g, or t
  misc_feature (12)..(12): n is a, c, g, or t
  misc_feature (14)..(16): n is a, c, g, or t
ctntgctacttntnnncatagaagattgaattccatcaattcttatgcctttggaggttcttgatgtgaccaagataattaaatatgtctccaattttgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgctaaagatacttcaagtgaagaagttaacctgagtcacattgtaccatgtgagccagttccagaagaaaagccaaaagaattacctgaatggagtgaaaaagtggctcacaacattttgtcaggagagtttataggctttaaaaggccatgctgtagcaggcgagtgataacaggctttaatctttttaaagcatgctgcgggatgggatattggcgttgagtggggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggtgagacctgcggaccagcaacatcacatcgtcctatctggaatccttagaaatgcagaattttagggacagacacacctactgattcagaatctgcattttcacaagatccctagttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataattttaatttgtgttt

SEQ ID NO: 461822 - DNA, 734 bp, Homo sapiens
  misc_feature (719)..(719): n is a, c, g, or t
  misc_feature (721)..(722): n is a, c, g, or t
  misc_feature (724)..(727): n is a, c, g, or t
  misc_feature (730)..(730): n is a, c, g, or t
  misc_feature (734)..(734): n is a, c, g, or t
ctgaataaatcgtcttttcaatttccagagggaaaacagcaccaccactcagatttctgatcgtgttgcttatctgaattttctgccgttgtcggattgcgccctcactacggtaaggttgtcagcatgctactgaccgtgcatccgagagcacccccggatgaaatcgcgtagatctgtcacaccgctttacctgcagaacttgataaaatcgagctggatagggtaggggctggtagcgcctcctccaatggtgaagggatttgcagcgtttctgcctttgcctttcccgtgggtgcacactgccctctctggccatcgtgtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagctgctccacgtcaaagaatagagttgacctttgatgaacattattatatagaaccatcatttgagtgtcgatcgttactgtggcgtgaaaagccctccattaattagatcaacagggagattcatgtggattaagtttagttctgatgaagagcttgaaggactgggatttcgagcaaaatattcatttattccaggnanngnnnnagnatcn

SEQ ID NO: 461823 - DNA, 716 bp, Homo sapiens
ggcctgggcgccccgcgcccgccacttcagtggatcccgcgccggggccgcgggcggagctgcctgccggtcccgcgccgcgcgtccgcactcctcggccctcgggcggtcgatgggacggggcgccgcggagcaggaggcggcgcccgtcggggtgctcgggccgcgcgggagcccactgtggggctcgggcatggcgggccgcaggacctgagctctcctcaggggagcggggaggcagctgctggccggcgatggggacggagtggggccgtcgccgccgcgccgagccgtgagcgccgagccaccgccgccgctacctcagcccttcgcagaagcgccgggcagctcgggaacatggccctggagcggctcttgctcggtcctcaaagtgttgttaataacagtactggtagtggaagggattgccgtggcccaaaaaacccaagatggacaaaatattggaatcaagcatattcctgcaacccagtgtggcatttgggttcgaaccagcaatggaggtcattttgcttcgccaaattatcctgactcatatccaccaaacaaggagtgtatctacattttggaagatccagactttaccttacctaggagggaccaacagcagatttctgcagaacgtggcaagactggtcggaagaatgggacaactaccagaagatgcggggctcctcaacggctcccgctgcatccag

SEQ ID NO: 461824 - DNA, 878 bp, Homo sapiens
aacaaagacccgcctataacaatggtatgctcttcattttcaaagtgctccaacaactcttgctgaggtacagggaagcactgtggtttagtaaaaaacatactcagactttggaatcagagaggcctgattctcctgtttatgacataaacatatgtggccttgaaggccattgtcttatttctccaccggaaagcaacttcagctgggctgttgaaattggccacaccattgccaacagtgacacagcacttcctctttcctgcttgagtcttcctccagttattagtttgaatgggagtggttcactgacggttcctggggtacttggagtcaaagcagctcacgcacgttcctgctttccaccaggaaacgtggagccacggaggccaaggaaatctgatcagctccagatccccaagttggtctttttacacccctaaagacaccatgcttgctccttctccaagactcataaggaaatacaaatgactttgaaatatcagccactgttaactggatcagattcctccagtaaatatgagagaagagtcatgacttttgctcagtcattaaaataagagacacaaggattggtatggggtatccctagcagaatttattcaaggaagcctaatcaatatcccccatctcactatttcttcagacacgtgctaagtttacatattcgaatcaaattaacatatcagagtcacaaattggcaatggtgtcaaaatacctatcctcaccattctaaatcatttttcacattaaatatgtcaagggctatgtttgcgtgcataagtcaaaagaagagaaataaagcaatacattaagaagttggtgacataagcttatttatttagttatttatttt

SEQ ID NO: 461825 - DNA, 5943 bp, Homo sapiens
tttgtgcatccctgctggacctcgtgttttaagcaacagatgaggaaactgaattccaagtgacaaagtgactccttgcccaaggtcacatggctagtaaaccttccatcacctcacatggcccgtgttccactcaaggctgcactcacagtctcttcaggagcctaccagaggcagcctgtccccttccacagccagagccgccacagagttggcccccagctctccaactcagctggcccggctgtgatctgacctaggaattccagaaagcacatgtgacccttagatccaaccccctgcctttggactgtgactctttgtcagattcctggtctcctcacaccccggggggatatgggccagccagagctccctccagacccctgttgtgcccccagggcactgattcctggtcactctctcctgtctccaagccctaggccctcagatctggattccttcaaaggctctgagaaggcacaggttacagtgggaccattattccccggagccaagctgttggcttcttgcttgtttaaacccagcgtcctggagacgggacagcacccaccccgtcgtcaccgcccgtccctgtcctgcagcgcagccaacgtgaagaagtgggagatcgagctgcagacccttcgggagagcaatgcacggctgaccacagcactgcaggagtcggcagccagtgtggagcagtggaagaggcagttctccatctgccgtgatgagaatgaccggctccgcaacaagattgatgagctggaagaacaatgcagtgagatcaacagagagaaggagaagaacacgcagctgaagaggaggatcgaggagctggaggcagagctccgagaaaaggagacagagctgaaagatctccgaaaacaaagtgaaatcatacctcagctcatgtcagagtgcgaatatgtctctgagaagctagaggcggcagagagagacaatcaaaacctggaagacaaagtgcgttccttaaagacagacattgaggagagcaaataccgacagcgccacctgaaggtggagttgaagagcttcctggaggtgctggacgggaagattgacgacctgcatgacttccgccgagggctctccaagctgggcaccgataactagggctggccgaggcccaggccccgcccgtgagtcccaagcgtgtgtgcgagaccagatagctctaggacgttcttctgtgtgcattgcttctgtaaatgcaggcgcagtttgtcgtgtttccaaaccagttgtgccgtccactcactccttttcagaatagaaatctcctctcgcttctctggccttgtgaggttgtggacaactggaagattctgactcaggaatccagaactaggtctaccttcaacatttatgcagtcagggcagggatgtttatatctttcataagggctgttgcaaccatatgaactgaaaaaacacgcattttgtaatccaaatattgatattctttacaccaagccatcaggctccttttatcaaatagcattcagagtatttgaatgtccaccagacaccagccccggggggcacagagagaacaacattcctctctgtcaacatcgagaggctttaaaacaactgtttagtggaaactttctgagagatggaaaacaagcttctggtgggtgcattttctggcccggagttgcctgcatccacgctactgccccctgccccccgcccccccagtttgtacggttgcaacagtgttccttttcttggttttaatttctgagcagatgattgtgctgtgggaacagcacacagtgagggtgcctagcacaatgtctggcacaaagtaggtgcttaataaatatttgttcaattaaatgtgtacacagaatttagtgttttaatcaaaccccacagcagagctgggaccctgtcgaatgatgcaccatctttgctgtgctgggtagttaacagacatgaataccactgtctggtcaaacccaagctggggctcgggtggccctggggcagggagggagaaggggaagcagcaggagctggtctcaggcccctggagcccatccgtgatgctctgcccctggggctctccagaccctcgaatcaccttctcccctaggaatggtgacccagggattccaggtataggggctgcccagggcttggtacctagggtaggattgtcttatgggtctggacagctgggaagaaatcacaggcatttcggggggagagagcagctcagctgacaagccttggccctcatgacagaggtgttccacccagctctgcgtcctgcctttttcagtttctcctagggaagggactgcagccataaacctctcctctctcacagagctgctcagtggggccagcgggcctgtgggtgctgttggcatcctgccctgggagattgcccgtgtgtggcaataatggcttgaatccctggccccacacatctctaaatgccttgagcaggggggaggctttggtgccccctcacccctttgagaaccacctaagaggactactccttctagaaaccttctcccatggacgtggttagactttctccctgctgaatttggattaatgagcaaacaacccgaggaaggagggagatggggtccgaacccaggtgccctgggccccaaggtgaacacgagtcctcctgctctccttcccttcccctcacggagacgcctctctgagctggggagtcttgtttgggatgtggatggaagggaaggctgggcatctggagcaccaaggcacttttagaggagctcccgcaagttcaccaagcactgaagagtgtggtgagcatcctgtgggcagcaggtgaggaacttggattcctcctgctgtgtgtccagctctacagctgttgcaaccctggagctaagagtagtaaggactcccttaaagggaaaggtaagttgggcttggccgtgaaagcacaacagcttttacaaaagcactgaactttccattccttctgcttttctctgaagatctcagtgtcttttcatttactttcttttaaaatagtggccctggagcaacctggacggtgttcccttgagctggtgtgacgtgccctcgtttattctgacatccagcccagtctcagtactgttgtcataaccttacgccagactcaggcagaatgtaagccattcactcgtgagcatcgcagccgcttgtgctgcctggaagctgcagggccaggactgcattttcagtttgcaattgaggtctcctgattttggtgtttccaagactggctgctataccttgataagctttccttctgcctccatgaaacctggtgtctaaaaaagatcaactaaaacttggaaccctttaaccaagaggacctttaaaaataacctttcattccagtcaagacccagctggatgcattttaaagttgggagtggcgaggaagccttcctagtgccgcccggggaatgtaaaaccaccagagcaacaggttgggacaggtcctatgactaattctggccaatgaaatgtgagcacaggtgacacatgaagctccagacagacactgaaatgcccatgagcagttccgcagtgtctgccttcccttccctcagcaaatgctgatgtcccagggacagagcctctgtcaagcctggatccctgagtgactacgtggagcagcccccttctcccttcatgttaccctcacctgccaccctgcatggacgggtagcatgaataaaaaaaataaaccttaggtgttaaacactggggtttcagggttaattggttaactgcagcataacatatcctgttgcaacaataaaaaagaatgcacatttttaggacttgtaatatgtattgcctcaaattgccttccagaaagacagacccaattatactcccacccacagtgtgtgagtgtgtactgcttcctctttaacactggagttaccctggggacagagagctaaaaaaaatatttttttggttaaaatgtaaccctttaaggtgttcagcagtatcattgatttctaagaggtttatttcataaacattgtaaaacaaaattttaagttgcacaaaaagtcaacagcatattcatcagttttttcctaaagtatgttttagcactttgaccatatgagacaacccttctgctgttagcatttttctctttgcaatagatcttcctatgtcagtacacatcaatctacctcattcttacctctgcataagagagtagtgtgtagttgtataatagtttaacttggcgattggttattgattttgtaactagccagttactgaattattctaaaggttttgctgttgttaatttctttcgcctttttcagttgggtaatagttctgggtaggttgataattttattcccatatttgtaatcttatttcactttctcaactcatcacattgactggtacttttagaacaatgttaaaaaacatttacataattgtgctgatattgtacattatttgatatatatatatcaaattttttttacttagaagagtgtttctccaaaactataaatttgactcttagtgtaaaataatcttaatatttgaattatacattcaggttatgccctctatttctagtttgatgaaaatattattagtaatggatgttggggttttattaaatggcttttttccacatctgtcaagatgatcaactggcttttctctattatgactttagatgaatcgttttaatagatttgctaatgttaagacatctctgcatttctacaagaatctgatgtagtcatagtatactattcttttaatatacatctcctttcaatgttaacagtggttatttatgattggttggtccatagtagatttttattttgtgtttcttatctgtactttctgatttttctacaaagattgtgtattacttgtataataaaaataagagctttaaattgtgaaattcttctggatttggttttctcattttattatggaatttttcatacctaaataagatgaatagttgggtaattttttttctgctttgtcagttattggtgtttgttaacttcttaaaaaaattaaaaagaacttgggaagctctgtttttctatgccctggaaacatttaaatatttagaattttttgctctttgaagtttttataacatgtatgaaactgtccaaatctagtagtgcctttttaggaaatatggggttgttgtttttttttaatttttttcatgctcattattttcttcaaactttatttctattctatttgttggcctggagttgtagtattctgcttcctcattcccatgttgcgtgtgctttccctttttgttctcattggtttttccagaattactctgtttcattgatcttttcaaataaccaactctgagatttatatcttaattttactgttttactatttcatgattcttttcgttttgttcttaattttttcctttattattttcccaccttcttaagttacatgccattttaactttttcttacttaataaaagacagttactaacattgtaagtttttgctttgtttctttttgatgttatttggcaaatgatctttttatatttaagggaaaaaatattttcctttaaaggcttgtatacctttgtgaattttacctgattttgttgtaatagtttctgtagaaatacatagttcagtaaaatatttgtgtctgtttttaagtcaacagaaatctttcagaaatcctttgtatcttgacaagatactttggaagttcttgatctccctaagccccaaaggccccagccctccggatgaaactaaaccactaccagggagggggacttgtgcctcttccatcgtccttttcatacttacagctgttaaatcattcattcatgttttcattt

SEQ ID NO: 461826 - DNA, 1501 bp, Homo sapiens
gccgagacaggacaaatatttgagctctggagtttgagaccagcctgggcaacagagtgagactctgtctctacagaaagttttaaaattagccaggtgtagtgacacatgcttgtagtccccattacttggaaggccaaggcgggaggatggcttgagcctgggaggtcaaggcatcagtgagcgatggttgtgccactgcctggagatagagtgagaccctgtctcaaaaaagaaagaaagaaagaaagaaaaatccctaagacctgacctgcctactccctagaaagcaccaaataaggaaaagcactccggaagaatgaagctaagaaggctgtgctctctgaggcatccgggcagccttcactggagggacaaggtccagtgggaccttcttactcaagatggcttcaattccaatcaccagagagttttgagaaccagtgggaggggttcctgggcagcggggctctgctcctaccgggatttgtttattcagctgatgttaataaatgaagctgaaggtaacaagctgtcacttagcatctccaggctggaccagaactgccattggttaagtttcagacttcagccccaaagtacagtgtcaccaccttggatgaaggatattaattagtgtcatgagggagatcacagtctcattcccctccgtcactagcacgagactgaaaaaaaaaaagaaaatcaaattcagttagaacagagacgtgctgagaagctgggccagagaccccgcggggaacctgccgttgtttgtcaaaaaacgaggccagcgaggaagaagccaaccatgcctcccgctccactcgctttggaacccacagaatgttcaacagggcagcacctttcagttattaagacactcagattccaccctggtgcagtgaagcaaactggattaaccacgcggcacgtggcagagccacagcgcaaaccacggctcctgctgctgaggaaaatacaggcacctcggccactctgggctgtggctgctcaggccatctttgatttctctctttctttcatacctcgcattctgtatgtcaaggaatatttggctctgccttcaaaatatccagaatccaatcacttctcaccacctccaatgcttccaccctggtccaagccaccatcatccaatggggccatcagtatggtctttcccctggatcactgcagtggccttctgactgcaatagcatcctacttccacctagtccctcctaccatttattctcaacacataggcagaattattctgccaacatatttggatctccccgtcctcagcacctagagttctacaagaccaccccgcttctgcttattagtttcctcatctgcagggagccagatttgaaataggactcccatttataatttatcattcatagtattaggctcatcggaaagtatgctttatccacatatttcacaaaactcttttaaaaattaattatgatttcattttcagttgttc

SEQ ID NO: 461827 - DNA, 1084 bp, Homo sapiens
cttaagcaaattaatgcaggaacgaaaaacaaaataccgcatgttcttacttatcgcgccactgcactccagcctgggtgacagagcaatagactccagctcaaaaaaaaaaaaaaaaggaaaagaaactgtatttactattcatcaagcgggagtggatcatcataaaggattggcagaggtggaagaaaattcacgtagaagtggacccacaaacttcaatcctgtgttgttcaagagtcaactgtattgtttcatgtattttgaagatatagaaaggatgtataatatgtatattatgcacgttcatgaactttactggaaccaggtggtaccttaccctcttgatactacaaaacctgcctcccactgcccctggtggggcattctgtttcggagtgcaatttccatgtggcccatgtagcgtgcagtgccctcctctcctgagctagtaatctccatgaggggaagacttgttcatccctgtagcactactgcctaaagcagtacctgacaaaatgacggagtctcactctgctgcccaggctggaatggagtggcatgatgtcggctcactgcaacctctacttcccaggttcaagcgattctcctgctttaacctcccaagtagctgggcctacaagcacacaccaccatggccggctaattttagtagagacagggttttgccatgttggctaggctggtctcgaactcctgacctcaagtgatccacccaccttggcctccgagagtgctgggattacaggcgtgaatcaccatgcccggcaatttaatatttgaaaagaacactgttaaaagaactgcaagcatgatgatatggaaacaccttccaaaatactagtttgaaaaaatgtatgaaatatcaggctgagttatcttcaaatatataaaaacgaccatctactagtgatagaacaatcttatagctacagacattttttcacccaataaaaccctaaaaacattgtcattttaatctttaaaataattataaataattttgagaggtcatgatatacctagaacttagtgcttttaactaagttgtatatagcagatg

SEQ ID NO: 461828 - DNA, 1179 bp, Homo sapiens
gggtgttcttctctgctgtgtaggctttgttcttttgctctttgcagtaaatgttgctgctgctgactgttgggtcccagccgtctttaaaagctattacactcacggtgaaggtctgtggtttcactcctgaaatcaagcgagtgtacgaacccaccggaaggaagaaactccagactccgaaggaacaaactctggacacaccaaatgtaagaattgtaacactcaccgcgacggtccgtggcgtccaccctcgcagcttctttcttgaagtcgccgagaccaagagcgcaccgaaaggaaccaattgtggacacatccgttttagtggaataatagtccttggttctctggacaaccgggagaattgcattttctgaggcccacgataagcacccaaccgttaatatttccatgcttctctgtccatcccatggagcctggggcttgagggactgtgcagtgaggcagcaactcacatctccagctgttggactggtcctgccagcgaccacttcgccttcctgccaccacgtgaagaaggatgtgtttgcttccccttctaccgtgattgttaatttcccttggaaaagtattgatgatcaagtgatgctagcagcaacagtgttaaaggctttaacgcttttaaagggagccagctcccacctgtgcaggattgtcgtggggactggcaagcagagtggaacagagctttgcttgttctctaggaacgtgacatctgaaatcggcagtttcaacctgcacatggggagaggccatactgacatgcagacagatgcagacacatggaggccaactataaaacgtagaaatccagacaatgatcacatcaaaggtgaccaatatggactgaagaccagaggatccttctctgagtcgtctggacagcagaagactgtaaagattccaatgcaatgtggggagggagaagggccccccaaaacgtgacttgggatttaatgtccctgctaccaaaaagatggctttggtgtccaaggatttgaaaagacgaattttagtttttacctttccatattctttagaacattaatatataataatagtatagaaaatgtatatacttgcaatatagataatttgtaaagaaagaagcttggtatgaagaaatgttttataggatttgaaagtagagtaatg

SEQ ID NO: 461829 - DNA, 609 bp, Homo sapiens
  misc_feature (3)..(3): n is a, c, g, or t
  misc_feature (6)..(8): n is a, c, g, or t
  misc_feature (10)..(10): n is a, c, g, or t
  misc_feature (13)..(14): n is a, c, g, or t
tcncannntncannaggagcacatagaggttgtctatacatacttaaatggcaataagaatgcacaaatcaggagaaataagctggccagtcattctagccacgtggaagcctggtgtaatggagttcatgggatagcccctacaacagagagttatccagcccaatatcaacagcgctggtctattctattaagaaccctggtctactgtgctagaaaaaaaatgcctccagcatctctttggcatcactgcattagagcgcagacctgtagacctgctgtcatgttgggcaggcccaggcataaggcacagaggaccttggtgaaatgggcagtcaggaggagacaaacccagccctgggctgggggagctgccttgctatgctgctgctccctgtggtgggaggattgcttgagctcagaaggtcaaggctgcagtgagctgtgatccataccactgcactccagcagcactcgggcaaccaagtgagactctgtctccaaaaaaaaaaaaaaaaaaaaagaaagaaaagaaaagggaaaaaaaagtaaacattgccccttctgtatgaaagacattagaaattcgacttgctgtttattcttgct

SEQ ID NO: 461830 - DNA, 713 bp, Homo sapiens
ggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaaaaaaacagacacagcaaaacacggcccaccagacacacaag

SEQ ID NO: 461831 - DNA, 2201 bp, Homo sapiens
  misc_feature (2)..(3): n is a, c, g, or t
  misc_feature (5)..(5): n is a, c, g, or t
anncngcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaaaaaaacagacacagcaaaacacggcccaccagacacacaag

SEQ ID NO: 461832 - DNA, 2110 bp, Homo sapiens
  misc_feature (2)..(3): n is a, c, g, or t
  misc_feature (5)..(5): n is a, c, g, or t
anncngcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcaggtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaaaaaaacagacacagcaaaacacggcccaccagacacacaag

SEQ ID NO: 461833 - DNA, 5273 bp, Homo sapiens
gcagggttgatgttcatgggtgattgatcatcctgtagcgacggtggtattgactgttccccagaggacaaggagtgtgttcttataatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctcaaaagaaaaaaaaaagaaaacaaaacaaaaaaagaaaaaaccaataatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaacacccaatgtttgagtgattctgtatactgatagggaatatcaagagtgttactgggttttgtgaatcacgggccttgaaagtattattaatgaataaatgacataatcaatagacaaggtgatcctatgaatatacaatgtgtttgcttttggtctttgggtttgttcacttcactgtattattataattggatcaatgaaataatttatacgtatacatgtacgtatatgaaggggatgaagtattgtccaattataaaataagtggtgaggcaagatgtattattattattatattaaagcattatattaaagctttaatatattaaataaaaatctaatattaatatataattaatgcaatatttaatatatattaaatatgataacatattaaaatattatattaaagcattgaagtcctaagggaaataaatggtaccccactgtaacgtctttgactaaggatgatacaggtggtagttatagataatggtcaacctctgggtcaaggaaagttgcacaaagtgttcattttcttaagagaaaatgaaataattatccttcagatagtgatttctcaaatgttttcctaaagggaagatgataaacacagatcatggaggactgttttatctgtttgtgatctgccgtcctctgtgagcctcaggatggatgtttgccagccgattccatggttacaagctctatagctgcatctatgtgttaggagcatgaagaccaataatggatgcactgagctgattatgaatttagccctgatgaagacttgtgttgctgtcatgatatgaaagattccagtaatgaacgcacttgagttgattcaagcacgcttccatggtcatgagctctgtggttgcatctgtgtgttaggagcatgcagaccaatagtgataatctcgaggtgatttatgcattcttccatggccaccagccttatgattgcatctgtgcgtcacagcttagagatcaataatggatgcaacaagctctttgaatcattctgttgggatcaagattgttgtgttccctctgtttggaaagagaccaagaatggatacgctcaggtgatttaagcagtcttccatggccacgagctctgtggttgcctctgtatattaagagcacagagattaaagtgagtaatggctgacattcttttcttggtttcagtatttcttttatcttaagattattcactatattattaaaaagcatgaaatacaatgaatgcaattataacccagtaataaatatgagatgtatgaaatattatatcaattaatgcatatataaaaaataggatagttaatgaaatttatgttgatatgagaataattctatatagaaattagggatataaggactcttcttgagtttttgtgaataataatactataattttatgattcaatgaattaatcaataaacaaatgtaggtgacaatagagcaaaagggccaatcctagatcagtgatgactactgttggtgtatgagtcatatacgatgaatacatgtctgaaattctgaggtccaatgtgaaagagatgtagctcatttactctggtttaagtgaccctgtagccagttgtcaggaatatacaaggatcttggttttggtcttttcattctatgcagaggatgtcttttttttttttttttttttttttttttttgcgctgttttctctgatttatatttctcagaatggacccactcaagctgacttcagaattcctccttggtcacaagctttttgattgcatgtctgcattaggagcctagagaacaatgtaatagctaaagttcttatcttgttttgcatagtttgtttatgggcagtcactgtattattaaaaagtgtgaaatataatcaaagaaggtgagctgtagcttagtaataagcatgggattaatatgagatattatttttttagtgtatacatgaaatactacaattattattaacataagagatattgaagtgagaatggttttaagtacatattagggatataaatctcttgcatttttgtgaatcacagagttttaaaattataattattaaattaatcaataaataacttagaaatgaattgaggaaaagtgggccctcctggatcaatgataaaacttgctggcatatgaatcttggataatggatgatacgtgtgtggaactctgaggtccaacacaaaagaaaagtgattttttttcatgcactttcattctattattgtaatcggatcaataaaataagtaaatcaagataaaatagatgaggcattgtccaaatatagaaatatgtggcaaggcaagaagtactattactatatgttgaaaatatgaaattcaatgagaaattaatgttgaccaacttggtgatttttcataaagccccgcagcaaggcatctggaaagctcctttcctgctcctgacagtcaccccgaacggcatgtttccaaatccacagaacatatgggctgcagagctcagagccttgctcctggcccagccaacaggatgctctcttctttccctggcccagtggctgtcagagcctcagatggaagagccagcgggaagcccccggcccacctggctgtatgggacattgacccggcacagggagaagacccagggggatgagcaatccatcagtaagtcctatcagcgtgacaccgtgaatgcctctcctcctcgcttccttccagttgcccctgcctggtcacaggcctcatcctccctctctggcccaattggatgccctctgcttgcttgcctcgtctctgactgtatcctgtgggtgacatgcatgcatacccggaccagcgtgaggattcagagataaagtaccttgcactggttctggcacataatgagtgctcaataatgtttttagatattatttatcctagaaaataatagatttttctgagatttaaaaacttattcacataggattataaatagtatttttatactagaattttaatgtatttctatgattacttcacttttgtcattcttaattttgtatgtgcatactttatctctttttcattagatgacctagaagaatatctattttagaggtttctcaaagaatctgttcttgggataacttgtcagttcaactggtttttgtgtgcctgtgttcaaattaaataatatctgtctttattgatttctttcttctgctttctttaagtttgttttatggatttgtccatatatgccctattgttattcttctttaataatgaaaatatttcatggtatgaacttgcttctgttcacaattttgactgcattttcatgtgtcttaatatgtggtcttcagaacattaaaatatttgttataaggcttcttgtttcttcttgttattggaagaaatgattatctgagttaaatgttcaaaactagagctgattttaaaaaattaatttctaattttttaaagttgtaagttgtttatacttttaattcaattgtggttatcttttattgtggcttgagaatgtggacacatacattctactttgggggaatttattgatgccttttttgtgcataatataattgattttgtaaatgatttttgtggacatttaaaagtaggatgtacttgtttataaggtatggattttgatgtaaagacatttagttttattagctttttagtctttatttggattttcttagtaaagaattacataatctataagcaaccgtattttgaatctcaatctaagagtttactggatgtacctggtttttgtttgtttcattacattggttggaactttttggacggtgacctaatgttgatgagatgaaggggcttctttcctgtttttctcatgttctgttaagtttgttgttgcttctagatttgaggtatgttcatcactgacttcttacttatttgatatttttaggactggaagagttttggatacgatgtttctattctttttccttgttttggtgctattttatttctaatgcaaatgttcatgaatgctatgtcattgttgtggattataccttccccctcagagaggtgtttaatgacctgaaatcacagaagcacatctgttttcttttcatttgtgttcctaagctaggtagcctcactttctcatgtaattgtttctgcaaagtgttgtttgaaagttgaactggagacttgcatgttccaaagaattttgctcctcgagagctcaatcttccaggcaatttctaacattccatggatgttctttagttttgttcttttcaaacactcagtcgactgccttaaattcaattatcaaggccaaggactggccacgttgggtccgcctaacgatgtccatgtttatactaatttcttaagtatataggagatc

SEQ ID NO: 461834 - DNA, 1999 bp, Homo sapiens
gcagggttgatgttcatgggtgattgatcatcctgtagcgacggtggtattgactgttccccagaggacaaggagtgtgttcttataatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctcaaaagaaaaaaaaaagaaaacaaaacaaaaaaagaaaaaaccaataatggatgctcttaaactgatttaagcacgcttccatggtcagaagccttatggttgccacagggtattaggagcatggagaccaataatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaacacccaatgtttgagtgattctgtatactgatagggaatatcaagagtgttactgggttttgtgaatcacgggccttgaaagtattattaatgaataaatgacataatcaatagacaaggtgatcctatgaatatacaatgtgtttgcttttggtctttgggtttgttcacttcactgtattattataattggatcaatgaaataatttatacgtatacatgtacgtatatgaaggggatgaagtattgtccaattataaaataagtggtgaggcaagatgtattattattattatattaaagcattatattaaagctttaatatattaaataaaaatctaatattaatatataattaatgcaatatttaatatatattaaatatgataacatattaaaatattatattaaagcattgaagtcctaagggaaataaatggtaccccactgtaacgtctttgactaaggatgatacaggtggtagttatagataatggtcaacctctgggtcaaggaaagttgcacaaagtgttcattttcttaagagaaaatgaaataattatccttcagatagtgatttctcaaatgttttcctaaagggaagatgataaacacagatcatggaggactgttttatctgtttgtgatctgccgtcctctgtgagcctcaggatggatgtttgccagccgattccatggttacaagctctatagctgcatctatgtgttaggagcatgaagaccaatgtgggtaatcgttaatgctccttcttgttttgaccattttaaaatgttatttgctatattattaaaaagtattaaacacaataaaagaaggggaaatatgcaatatttaaaatctggattaaaaactttaggttaattaatgcatatgtgaaacattgagctcagttaatgaaagaaatatggtcttcgtggaaatgattatatggatgaatgttagggatattcaagaatcatattctttttttgaagacttaggtgtatttccttgttagtgaattagtcaacaaacaaatttagatggtaatagagaaagagggctgatcctggaccagtgatggtgactggtggtgtgtgagtcatgcacagtgaatatcatgtgtctggaactctgaggtcca

SEQ ID NO: 461835 - DNA, 3520 bp, Homo sapiens
taacggtttgtggatgttttaattttacttttacgtgataacctgcaataactacacagatgcatgcatttttgtgcttatttcttttctctcttccagcatcctctgcttgtgtttggcccggcacttcctggcagaatggtgggcccccaggtcctgatagcggtcctggtcttgagccgctcctggataatattgacgatttcttgatcgactttgtagtccctcctccactgcatttcggcttcatatatgcacagtgtttcacgtgtccatgtgaagacactgatgcccagcacgcggcagtactgccggtggtagtagtaatacctgttctttgcgtgctgccactctataaactctcacgagggtcgccggtcggtccactaggaggtcgaaggccttcatcaggtagacgacggggttgggcagccaagaacttcataatcagcccttttctattctcacagaatagaagttgtgtcaataacaaatggaaatcactgagctccaaaattcagctgccctaacctggctgcttgtccctatcagagattttagaatgttttccccttcagatgaatttcagtttcactcaatcctaccagtgtttgatgacaacactcatggaaaactaatggtaaattaatgtctgccttccaaagtacgtggttgagttcactgtgtaaaaaaataatgataataatactaaaggcagccaaactgctgattggcagaattttttcccatcacttaaggcatttgagttgcagtgaggctggcgcacacaaatccttgatgtctagaccgcctttctccagctgctgtgtttactgcagaaaggttccatcctgggatgatcgcctggggggagttttcttcttgcgacacctagttcagctctgctgagcttttggattcccagcctttctcccaccacaacccggtggtcatgaagtctcacaggaagtgtgagggtgatataatgtgtgtaaatgcagattcagcttcgaggaaactttcgtctaataatgaactgaaccacattatggcatgctatctccaagcctactcagtgtaaagacgatgaggatgaagacctttaggatgaccaccttctacttaatgaacagtaaatatattttctcttttttatgattttcttaagaacatttcattttctctaactgtattttaagaatatgtaataaatacatgcaaatcaacttatcagtaaggcttctagtcaacagtatgctattagtattaatagttaagtttatggggagtcaaaagttatatgtagatttttagccaggtgtggtggtgcgtgcctatagtcctatctactgggaggctgaagcaggaggattgcttaagctgaggagtttgaggctgccatgagctatgattgtgccactgcactccagcctggacaacagtgcaagactctattaaaaatttttttttaaattatctgtggttttttgattccacataggagtggcatcccaaccctcacattattcaagggtcatctgtaaatgcattaaagatgttgagagccaggtttctcaccgccaaagaagttacaaataagaggaaggggggctacaatgaaccctgtcatgttggattggaatctgagctatcacagtatgaatttgttttttaacattttatgtatatacagttacagaaatatagatgtgcatggcttagtatacatatgtattatttcaagctctgttctctatgaggccctagaagcaatgacatccagtgacaataaacacactcagtgcccagatttttgtttctaaataaaaggaaccaggcctccctggagcagtgattgattccaggctcctaggcagggaaaacacaagaagagcctggaacatcttgaaatgcaagaaagtaaggaagtgctcatgaaaggatggggcaggtcacaagtgtgcaggagccaacctgaaagagctccccgtggccaagctgggacaatttgagcaataaaataatgatggtattataatccataaaataaatatccatgagtccatactcatataaacaagcaaacaaatagatgagaaaggacagtaattctccagatagaatttcaattacttataataataaatgaggaaatcatgataattaatgagggaaataaaaaatcaccattaggcaaacactacagtaataattattacaggcacaatctactaatagatgttaagatgactgggcaaaaatttgaggtgaatcaggatatttgcatagccttaaactatctctcccaagatatttattaattacaaaggtaaaaatagtaactttacagtgaagaaacccagcagacacaactttaaccaggcgaccaaggttaacatcaccagtggcaggacatagcagcatcctatcccactaacaatatgcattgagggtttattaccttggtgatattcttcgaaggatggataacctacatttaatcttgagaaaacatcagataaactccaaatgagggagattctacaaagtaactgaccagtactcctcaaaaatgtcaagatcatgaaagacaaggaaagatagaggaactatcacagatgggagaagaccacagacctgaccactaagtgcagtgtgggatcctgagtggctcctgaagaagaaagcagaagttagataactagatagacaattagtgacaatttaataagctctgtcagttatatagtagtattgcctttatgttaatttcctgatttttttttttttttgagacggagtctggctgttacccaagctggatgtggtggcaccatcttggcttactgcaacctccacctcctgaattcaagcgattctcctgcctcagcctcccgagtagctgggattacagtgaaggcactgcactctcctttcctggctcctggtcctcactctcccctcaccctccacatggatgctgcccagagacactcctccacttcccagctgcctgctggggcatttccactgaaaagttccaccattacttcatgctccatggaaccttcaggagctctcctgaaaagcagcctctttccatattgttcctatttctgatgctccaaggcacccagcctggaagcctcagctttgcctttgccagttccactccctcattgcacacatctggtcaccaagacatctggtcttccaaacaagagcccttcccttcccttttcccttcccttcccttcccttttcccttcccttccccttttccttccctgtgcttcccttccccttctccttcccttccccttctcctgccttccctccctccctcctttctctttttcttcccttccctttttccttcccttccttttccctcccttccccgtttccttcccttcccttccctttttccttcccttcccctttttcttcccttccccttttccttaccttctgcttttccttcccttccccttctctctctccttccttccttcattag

SEQ ID NO: 461836 - DNA, 1373 bp, Homo sapiens
gaatcttgttgcctgaactattttaaattaaggagccagatctttttagtgaggctatcctgacaagacttgatctaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaagtattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaagtgagtaaaatctatttgaaggtatcttctttgtaaacatttgtcagattctaatttttctttttgtattaaaattcaactatagatgtatgtgaaacaaaataaatggagatagtttttctcccacagacagaggtgtctttgaatgtgcgctaatgattatcttcaattgtcatcacgtcagagaaaaatcttcaggggtgctaatcctgtcgcatcagttgatcatactaacgaaaaagtgttcttacacattgtattactgcattgtggtaatagcttctataaaatctgccatagctggattatgcagctttgcaaaaattctactagattttattctaactcatattagctttgtcctatcaacttctggaatttatctaattattgcttttaaaagtttcctgcctttcaacgtttccctgctatgcaaaacctttcccagaccttggtttcttaaaagaaagatgttgctacagttcccaattctttcttattacaggctcaggtgtacagctgctgctgctcctcagcagtccatcccctggacagagatggcctctcaggacctggagcagagctgtaggaagctgccctctcttatggtagatgtggcccatcacaatatacctgctgcctggacaaaataaccagaacattaattcatagc

SEQ ID NO: 461837 - DNA, 1930 bp, Homo sapiens
ggacatcttgagctgaagcagggttttgagccactgctgctgctgccattgtcaccatggtctcagctctgcggggagcacccctgatcagggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaatatggctctcagctctcagtgtgtctgcaggtgccatgtcagagccagagcacctcctccatggtccaaccatccatctttgaaggattcgtgccttctacttcaacttcagacttctgttgcctgcctggcctggttgcttcactgggtcccattcagcttgtctgggagaggagcccaggaataggtgtagtgaagctcttggaaccaaagagaacattgttaaaggatttgggggctgtgagcagtgatgatggccacagtctcttcaagatggggctggactgggatcaggcctggacaagggaccctgaaggcctgggctgggtggttgaccaggagcaggtgaagacggagctggagaaggagtatttagggaagagggccctgatcaaagccagggaggcctcccttgttatgagggctacagagtgtgcaggcccatctgaatgtagaggccaggggagcctctatgttcagagctcagctcctgaaggacatgctcaggacgattgcaatggcttcctaagagtgttcgtgtctctaaccttggtccttgcaactccacctcctccctcagagtgagctttctatcttgtttctgccttgcatcctaggcccaatagcttttcttatcttatagggttaaagttcaagttccttgggttggtatacaaggtctttcatgaccaagactcagctgactgctacagattcaactctcacctgttcggaaacttttgctctagctagtttgtgtccttggcggtgccaaaggtttaaaaaaattatgggagaaaacaacactgatcaaatgctatctatccttttattttttcttctttctgtaaattgaaaaatgacagtcattatgtgattttaggagaagaaatgttggttgcattttgtgctgctgtacatccccaagatcccgtgtctggggtcatgtgccattaattaattaactaattaattgattgatccaatcctctgaagtcactgagaattcaaccttgtggtttggacttgtgattgctccaaactcctagccttggtgtcatcttttgggtcactcctgaaaatgggacaactccctgagtctcccttctccaccagacttccccagg

SEQ ID NO: 461838 - DNA, 2017 bp, Homo sapiens
ggacctcgaaggggcagttatggtgggagccatccaaggtgtcacagggctgggcttttcatttaacaaatttgttctgatggatgtgtatagaatagcttggaagagtggttgagacatgatacaagaagaccatgaaggaagccaggatggaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgcctatgctctgccctatgcaggggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaatatggctctcagctctcagtgtgtctgcaggtgccatgtcagagccagagcacctcctccatggtccaaccatccatctttgaaggattcgtgccttctacttcaacttcagacttctgttgcctgcctggcctggttgcttcactgggtcccattcagcttgtctgggagaggagcccaggaataggtgtagtgaagctcttggaaccaaagagaacattgttaaaggatttgggggctgtgagcagtgatgatggccacagtctcttcaagatggggctggactgggatcaggcctggacaagggaccctgaaggcctgggctgggtggttgaccaggagcaggtgaagacggagctggagaaggagtatttagggaagagggccctgatcaaagccagggaggcctcccttgttatgagggctacagagtgtgcaggcccatctgaatgtagaggccaggggagcctctatgttcagagctcagctcctgaaggacatgctcaggacgattgcaatggcttcctaagagtgttcgtgtctctaaccttggtccttgcaactccacctcctccctcagagtgagctttctatcttgtttctgccttgcatcctaggcccaatagcttttcttatcttatagggttaaagttcaagttccttgggttggtatacaaggtctttcatgaccaagactcagctgactgctacagattcaactctcacctgttcggaaacttttgctctagctagtttgtgtccttggcggtgccaaaggtttaaaaaaattatgggagaaaacaacactgatcaaatgctatctatccttttattttttcttctttctgtaaattgaaaaatgacagtcattatgtgattttaggagaagaaatgttggttgcattttgtgctgctgtacatccccaagatcccgtgtctggggtcatgtgccattaattaattaactaattaattgattgatccaatcctctgaagtcactgagaattcaaccttgtggtttggacttgtgattgctccaaactcctagccttggtgtcatcttttgggtcactcctgaaaatgggacaactccctgagtctcccttctccaccagacttccccagg

SEQ ID NO: 461839 - DNA, 987 bp, Homo sapiens
gttcctaacatggtcttgttcctaccagtctgtggcccgggggttggagacccctgtatcagtggacggtctctatttgtcagcagttccatgttaacaagtaagagcatgccttttgatactacacaagtgttttccccaacttgttctcccaggaaacttctactgggtcttcaaaatgtaattcaaattgtcacttcttttccaaatacctctatcccactcataccaaagcagcaggccaagggaaacagccatgaggcttcagcttcaacaacaggacctcaaaaacaggagacgctcaggaccaaccggggcattggcctgagcccagctgcctccaggcaattctcctcctgccctgatggctttcaaaagagaaatgcctgggagcatcacgacctgtgcagactccccagcatcataacaggaaggtcccacgatcacgagcacattgccttcagcatccagcactgaatatggtgaattgcactctgaagagcttcctaagcttgtaagaaagtgattctgaaaagctcaacattttggtagaatggagagatttgacattgcttctgctccaaaagcaaaagacttggcccagaagctaaaaatcacctgccatcttggaaataatccctggaggatcaagtccaagggggagaagtggactggtcaccccagccgaggttatctaagttccatggcttactccagacaggaagccccacatcctgcagcctcattcataatccataatagatggtgttcttggatcccaagttgagaaaagaagttaactatgcacattttggcaaagatgcagaccagggtttgatctaagcagctatcacataaaataataaagtacaaatggaaatggcaaaaatgtgcccatatcacagtgcagagtgtgccaaagctgaccgaaaaattatgcatttttcatgtttcaataaacgtacttaactggcattttgtgggaca

SEQ ID NO: 461840 - DNA, 898 bp, Homo sapiens
gttcctaacatggtcttgttcctaccagtctgtggcccgggggttggagacccctgtatcagtggacggtctctatttgtcagcagttccatgttaacaagtaagagcatgccttttgatactacacaagtgttttccccaacttgttctcccaggaaacttctactgggtcttcaaaatgtaattcaaattgtcacttcttttccaaatacctctatcccactcataccaaagcagcaggccaagggaaacagccatgaggcttcagcttcaacaacaggacctcaaaaacaggagacgctcaggaccaaccggggcattggcctgagcccagctgcctccaggcaattctcctcctgccctgatggctttcaaaagagaaatgcctgggagcatcacgacctgtgcagactccccagcatcataacaggaaggtcccacgatcacgagcacattgccttcagcatccagcactgaatatggtgaattgcactctgaagagcttcctaagcttgtaagaaagtgattctgaaaagctcaacattttggtagaatggagagatttgacattgcttctgctccaaaagcaaaagacttggtcatcctctggttacttagcttaggtgactgcagcaagagatgtccagagtctcaacattgggtgattgaagagcagaaagactggcatgaaatatctgtcaacatagctcaacaaggaatcaggaagagagagtcttcaagatggctgactagaggcatctggtacttgcctcctccacaaagaagaaccaaaatagcaagtatattattacacttcgaatagatcatctaagaaagaacactggaattcaaccaagaagtggcaataaatacctaaggcaaggaaggagagggaaat

SEQ ID NO: 461841 - DNA, 833 bp, Homo sapiens
gttcctaacatggtcttgttcctaccagtctgtggcccgggggttggagacccctgtatcagtggacggtctctatttgtcagcagttccatgttaacaagtaagagcatgccttttgatactacacaagtgttttccccaacttgttctcccaggaaacttctactgggtcttcaaaatgtaattcaaattgtcacttcttttccaaatacctctatcccactcataccaaagcagcaggccaagggaaacagccatgaggcttcagcttcaacaacaggacctcaaaaacaggagacgctcaggaccaaccggggcattggcctgagcccagctgcctccaggcaattctcctcctgccctgatggctttcaaaagagaaatgcctgggagcatcacgacctgtgcagactccccagcatcataacaggaaggtcccacgatcacgagcacattgccttcagcatccagcactgaatatggtgaattgcactctgaagagcttcctaagcttgtaagaaagtgattctgaaaagctcaacattttggtagaatggagagatttgacattgcttctgctccaaaagcaaaagacttgggaagggcaccctgggagttgagaacatccaccacagagaggtaagttcctacttggcagtttgccgcagcaattaccacctcgtgctccatcactacctttccactccgtctcccacccttacaccaggcttgtgattcaaaggccttcaggccaggggtaacaaactatggcctgtgggccaaatctaacccactgactgttttccaaataaagttccactggaacacaggca

SEQ ID NO: 461842 - DNA, 975 bp, Homo sapiens
ccctaacttacaatcaccgaacccatgaggtcaccctatctcccagccctccttcaccagatacaggcagaaaccctcaagccagctgagcaaggctttacggaggcaagggagttagccataagactatctgtggttgagcattccaggcaggcagcagcaagagccaccacgaaggccagaaggcagggtcatgcctggctcgctccagcaacacgaaaaaggggtggagtgtggagagccaagcaaaaaagatgaagtcacataagtagcagaagacccggttgtacaaggcctggtgtgccaccgtaaaaacatggactcctcctcggaaatatggagccactgggggagtttgagcaggggaagaagatctaacaaagaactttcacacttcctgtgggagtgcaaattggtggcgtatccagagttgtttgttcctccggatgggttcgtggtcccgctgacttcaggagtgaagcacagacctacatatcctattacatctttcttggaatgcagaagccatacaacagaaaccacagtggcttccattttgaagagccttttgcagggacaagggcccatttatatattcaaactgatggtcagcaaagctgtggttttcccacggtcacacggagtgtccacaatagagcccaaccaagaagaattccaatctccatcacaccccactgcctgcatgcaggactccaggtgggcacggtgtatcagtagggcacattcagcagctggtgatgggggcgtggcagattgtgttgaagtggcttaaagcactaaggaggatttattgagttatataacgtgaagccctgaagcagtcagtcttctggattggttgataggggctcaatggtgtcatcacagtcccaattttgtcctactttgccatccacaaaggccatagtaggttggatggcaccctgatacagtttggctgtgtccccacccaaa

SEQ ID NO: 461843 - DNA, 2807 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgtttttgtgagaatgaatttttatactttaccccgaccccaccccctaccccccgcccaggtaaatccaagtaaatgattttctgaaggtcggtctcctagaaagcgtttaggctctggttttttgttttgtttctattttcgtgttttcccagttagggaaggaagaggagcctgtgcagagttgaactggggtggagaggtgccttgtaaagtatggtttccagagatggtgagacctcgtagctaagcgttgtttcctctgcacgtaactgtgagttgtgaacttgtggctcctgggggagcgggacagggcctggcagtgcgggggagggggcaaggaattcaggaagttggcgagaattcttcgtttttcattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttctacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacagaaaaccaggctgcctgacgtctccaatgtgccttttccccaatgcatctttggcgctagggaccgctctggggaagacaagcatgttttcaaagccactcccatgagccccagacccgcgcgtggagcttcctgggcgcgccccagctggtctggaaggccggcaaattaggaagtttggagggaagaggtgcaccccaaactagggagaaacccaagagctggggagaaggcccccactagtgtccaaagtacgcggacagctcttaaaagttattgttttcttcgtggggatatatattttttcttttccttcctttcctttttttttttctttcaccctcgcatgtctcctctttcgggatttgctaatcttgaacgaaactgttctctccggactgtttcgacccaatgagcggcccctcctgggcaagtcgtcccccttaccctcacagagggctggctcccgggcgcggcctgtccccagggttgatttatttcggccgcgccacaccactattcgcgattcgaatccacccagaacactgcagccaattgggcagggggcgggggcttggctgccaaacgggaagggtgtttggggacccagtcttgcgccgcttccggaggagcggcgagacccagcaaggacccgcgtccccgtgcacctccacccccgcaaactcacgctcattttacgatcctgtcacaaaactggctgcttcggcgatgtttcataaggaaaaagaatgcatttctgacttaaaacatatttttaacttagatttttaacagcccagatttatgaggccttctcgcttataccatatttcttccccgtctctgggacgcttttacccaagggacccggggtcacctcagagccccccacccctgccagcgtctggggccagtgaaacgtcaggtggtggcggcggaaacttgcaggtcgcccccacccccagcgccggctcccgccggcggccacttcggggaaggaccgcgcggagccagcgccggggtccccgggcggtcggaatcgaggcccggcgcgttgcgcaggccaggcccggcccggaggccccttgcccggcgcagcccccggccgacccccgtgcgccgccggcggccgccagcacggcgcggaggtgggctagcggcggcggcgcacgaaaggtcaccgcggtggcattcctctccgcgctgtttacgtgacttaatgtactcgctgcgccgcgggtaagttcgggctgcgataagggggcggccgggggagggtcgccgtaaaagccccacgccgggcgcctccagccctcccctcatccattaacctttttactttcttctccgctctctctccaagcctgttatctaggccacccaatgaccgacgaaagattttccctccctgcttctcccgtggccgctttaaaccaaataaatttagctattaagggccaagatgtctgacaaaagatcgaaaggtgtctttcc

SEQ ID NO: 461844 - DNA, 3102 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgtttttgtgagaatgaatttttatactttaccccgaccccaccccctaccccccgcccaggtaaatccaagtaaatgattttctgaaggtcggtctcctagaaagcgtttaggctctggttttttgttttgtttctattttcgtgttttcccagttagggaaggaagaggagcctgtgcagagttgaactggggtggagaggtgccttgtaaagtatggtttccagagatggtgagacctcgtagctaagcgttgtttcctctgcacgtaactgtgagttgtgaacttgtggctcctgggggagcgggacagggcctggcagtgcgggggagggggcaaggaattcaggaagttggcgagaattcttcgtttttcattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagttccgaccaaatgtttaagtggactgggttttgcagaagctcatttgtaagcactgacggaaatgggttgtgggcatttgatttcctttgattccaacgttttgaaataatgtttctcggatttgctattcgaagcaattttctaaaaactcatatcttatttgctaaaaataaactctttggctcagtttgtgtccaggctgtgtacggcctccaaccctgagccccgaggagatcgagccctggcgcgagcctgatctctgtcctgtgtgtttctttgtatttgcaagtacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacagaaaaccaggctgcctgacgtctccaatgtgccttttccccaatgcatctttggcgctagggaccgctctggggaagacaagcatgttttcaaagccactcccatgagccccagacccgcgcgtggagcttcctgggcgcgccccagctggtctggaaggccggcaaattaggaagtttggagggaagaggtgcaccccaaactagggagaaacccaagagctggggagaaggcccccactagtgtccaaagtacgcggacagctcttaaaagttattgttttcttcgtggggatatatattttttcttttccttcctttcctttttttttttctttcaccctcgcatgtctcctctttcgggatttgctaatcttgaacgaaactgttctctccggactgtttcgacccaatgagcggcccctcctgggcaagtcgtcccccttaccctcacagagggctggctcccgggcgcggcctgtccccagggttgatttatttcggccgcgccacaccactattcgcgattcgaatccacccagaacactgcagccaattgggcagggggcgggggcttggctgccaaacgggaagggtgtttggggacccagtcttgcgccgcttccggaggagcggcgagacccagcaaggacccgcgtccccgtgcacctccacccccgcaaactcacgctcattttacgatcctgtcacaaaactggctgcttcggcgatgtttcataaggaaaaagaatgcatttctgacttaaaacatatttttaacttagatttttaacagcccagatttatgaggccttctcgcttataccatatttcttccccgtctctgggacgcttttacccaagggacccggggtcacctcagagccccccacccctgccagcgtctggggccagtgaaacgtcaggtggtggcggcggaaacttgcaggtcgcccccacccccagcgccggctcccgccggcggccacttcggggaaggaccgcgcggagccagcgccggggtccccgggcggtcggaatcgaggcccggcgcgttgcgcaggccaggcccggcccggaggccccttgcccggcgcagcccccggccgacccccgtgcgccgccggcggccgccagcacggcgcggaggtgggctagcggcggcggcgcacgaaaggtcaccgcggtggcattcctctccgcgctgtttacgtgacttaatgtactcgctgcgccgcgggtaagttcgggctgcgataagggggcggccgggggagggtcgccgtaaaagccccacgccgggcgcctccagccctcccctcatccattaacctttttactttcttctccgctctctctccaagcctgttatctaggccacccaatgaccgacgaaagattttccctccctgcttctcccgtggccgctttaaaccaaataaatttagctattaagggccaagatgtctgacaaaagatcgaaaggtgtctttcc

SEQ ID NO: 461845 - DNA, 1095 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgtttttgtgagaatgaatttttatactttaccccgaccccaccccctaccccccgcccaggtaaatccaagtaaatgattttctgaaggtcggtctcctagaaagcgtttaggctctggttttttgttttgtttctattttcgtgttttcccagttagggaaggaagaggagcctgtgcagagttgaactggggtggagaggtgccttgtaaagtatggtttccagagatggtgagacctcgtagctaagcgttgtttcctctgcacgtaactgtgagttgtgaacttgtggctcctgggggagcgggacagggcctggcagtgcgggggagggggcaaggaattcaggaagttggcgagaattcttcgtttttcattcttcgttgtaaattgcttctaaacacttctgaattttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagttccgaccaaatgtttaagtggactgggttttgcagaagctcatttgtaagcactgacggaaatgggttgtgggcatttgatttcctttgattccaacgttttgaaataatgtttctcggatttgctattcgaagcaattttctaaaaactcatatcttatttgctaaaaataaactctttggctca

SEQ ID NO: 461846 - DNA, 2419 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgtttttttagggaaggaagaggagcctgtgcagagttgaactggggtggagaggtgccttgtaaagtatggtttccagagatggtgagacctcgtagctaagcgttgtttcctctgcacgtaacttttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttctacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacagaaaaccaggctgcctgacgtctccaatgtgccttttccccaatgcatctttggcgctagggaccgctctggggaagacaagcatgttttcaaagccactcccatgagccccagacccgcgcgtggagcttcctgggcgcgccccagctggtctggaaggccggcaaattaggaagtttggagggaagaggtgcaccccaaactagggagaaacccaagagctggggagaaggcccccactagtgtccaaagtacgcggacagctcttaaaagttattgttttcttcgtggggatatatattttttcttttccttcctttcctttttttttttctttcaccctcgcatgtctcctctttcgggatttgctaatcttgaacgaaactgttctctccggactgtttcgacccaatgagcggcccctcctgggcaagtcgtcccccttaccctcacagagggctggctcccgggcgcggcctgtccccagggttgatttatttcggccgcgccacaccactattcgcgattcgaatccacccagaacactgcagccaattgggcagggggcgggggcttggctgccaaacgggaagggtgtttggggacccagtcttgcgccgcttccggaggagcggcgagacccagcaaggacccgcgtccccgtgcacctccacccccgcaaactcacgctcattttacgatcctgtcacaaaactggctgcttcggcgatgtttcataaggaaaaagaatgcatttctgacttaaaacatatttttaacttagatttttaacagcccagatttatgaggccttctcgcttataccatatttcttccccgtctctgggacgcttttacccaagggacccggggtcacctcagagccccccacccctgccagcgtctggggccagtgaaacgtcaggtggtggcggcggaaacttgcaggtcgcccccacccccagcgccggctcccgccggcggccacttcggggaaggaccgcgcggagccagcgccggggtccccgggcggtcggaatcgaggcccggcgcgttgcgcaggccaggcccggcccggaggccccttgcccggcgcagcccccggccgacccccgtgcgccgccggcggccgccagcacggcgcggaggtgggctagcggcggcggcgcacgaaaggtcaccgcggtggcattcctctccgcgctgtttacgtgacttaatgtactcgctgcgccgcgggtaagttcgggctgcgataagggggcggccgggggagggtcgccgtaaaagccccacgccgggcgcctccagccctcccctcatccattaacctttttactttcttctccgctctctctccaagcctgttatctaggccacccaatgaccgacgaaagattttccctccctgcttctcccgtggccgctttaaaccaaataaatttagctattaagggccaagatgtctgacaaaagatcgaaaggtgtctttcc

SEQ ID NO: 461847 - DNA, 2595 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgttttttttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagttccgaccaaatgtttaagtggactgggttttgcagaagctcatttgtaagcactgacggaaatgggttgtgggcatttgatttcctttgattccaacgttttgaaataatgtttctcggatttgctattcgaagcaattttctaaaaactcatatcttatttgctaaaaataaactctttggctcagtttgtgtccaggctgtgtacggcctccaaccctgagccccgaggagatcgagccctggcgcgagcctgatctctgtcctgtgtgtttctttgtatttgcaagtacaaggatgtctgcgtggatatccctggacactcgataccccccggggacctgcttttcccgcagctccgcagacgcggcgggagggcgcgctggccccggcgctgctgggacagaggtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacagaaaaccaggctgcctgacgtctccaatgtgccttttccccaatgcatctttggcgctagggaccgctctggggaagacaagcatgttttcaaagccactcccatgagccccagacccgcgcgtggagcttcctgggcgcgccccagctggtctggaaggccggcaaattaggaagtttggagggaagaggtgcaccccaaactagggagaaacccaagagctggggagaaggcccccactagtgtccaaagtacgcggacagctcttaaaagttattgttttcttcgtggggatatatattttttcttttccttcctttcctttttttttttctttcaccctcgcatgtctcctctttcgggatttgctaatcttgaacgaaactgttctctccggactgtttcgacccaatgagcggcccctcctgggcaagtcgtcccccttaccctcacagagggctggctcccgggcgcggcctgtccccagggttgatttatttcggccgcgccacaccactattcgcgattcgaatccacccagaacactgcagccaattgggcagggggcgggggcttggctgccaaacgggaagggtgtttggggacccagtcttgcgccgcttccggaggagcggcgagacccagcaaggacccgcgtccccgtgcacctccacccccgcaaactcacgctcattttacgatcctgtcacaaaactggctgcttcggcgatgtttcataaggaaaaagaatgcatttctgacttaaaacatatttttaacttagatttttaacagcccagatttatgaggccttctcgcttataccatatttcttccccgtctctgggacgcttttacccaagggacccggggtcacctcagagccccccacccctgccagcgtctggggccagtgaaacgtcaggtggtggcggcggaaacttgcaggtcgcccccacccccagcgccggctcccgccggcggccacttcggggaaggaccgcgcggagccagcgccggggtccccgggcggtcggaatcgaggcccggcgcgttgcgcaggccaggcccggcccggaggccccttgcccggcgcagcccccggccgacccccgtgcgccgccggcggccgccagcacggcgcggaggtgggctagcggcggcggcgcacgaaaggtcaccgcggtggcattcctctccgcgctgtttacgtgacttaatgtactcgctgcgccgcgggtaagttcgggctgcgataagggggcggccgggggagggtcgccgtaaaagccccacgccgggcgcctccagccctcccctcatccattaacctttttactttcttctccgctctctctccaagcctgttatctaggccacccaatgaccgacgaaagattttccctccctgcttctcccgtggccgctttaaaccaaataaatttagctattaagggccaagatgtctgacaaaagatcgaaaggtgtctttcc

SEQ ID NO: 461848 - DNA, 2259 bp, Homo sapiens
aaaagggactggaaatgaacgtcgcggggttatcagcgccgatctgtcagcggcaactcgcgcggccgcaggctcgtccgctgcaggagccgtgatatatgtctcgctccctttcgcttacagaaaggatttcttccgacagacgtgaccccagaaggctgccgagggagactttaggacaagaggcgttgtttttttagggaaggaagaggagcctgtgcagagttgaactggggtggagaggtgccttgtaaagtatggtttccagagatgtttcagcgtggccgcatttggaaaaggctgaaggtagaaaactctggaatggagaggctggcgactggagcaggatccaggggctttaaattttaacctgaatgcgatcgaatgcgcgactcccagaagagatagccaggcgtccgcccggccgctcaacccccgccaggactcggaatgccttgcttttggttcttttcgtgagcagcggggtggacattgaccgattcgacaacgttcgggctctaagggctcgggaagggacccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgtacagttgattcagacagaaaaccaggctgcctgacgtctccaatgtgccttttccccaatgcatctttggcgctagggaccgctctggggaagacaagcatgttttcaaagccactcccatgagccccagacccgcgcgtggagcttcctgggcgcgccccagctggtctggaaggccggcaaattaggaagtttggagggaagaggtgcaccccaaactagggagaaacccaagagctggggagaaggcccccactagtgtccaaagtacgcggacagctcttaaaagttattgttttcttcgtggggatatatattttttcttttccttcctttcctttttttttttctttcaccctcgcatgtctcctctttcgggatttgctaatcttgaacgaaactgttctctccggactgtttcgacccaatgagcggcccctcctgggcaagtcgtcccccttaccctcacagagggctggctcccgggcgcggcctgtccccagggttgatttatttcggccgcgccacaccactattcgcgattcgaatccacccagaacactgcagccaattgggcagggggcgggggcttggctgccaaacgggaagggtgtttggggacccagtcttgcgccgcttccggaggagcggcgagacccagcaaggacccgcgtccccgtgcacctccacccccgcaaactcacgctcattttacgatcctgtcacaaaactggctgcttcggcgatgtttcataaggaaaaagaatgcatttctgacttaaaacatatttttaacttagatttttaacagcccagatttatgaggccttctcgcttataccatatttcttccccgtctctgggacgcttttacccaagggacccggggtcacctcagagccccccacccctgccagcgtctggggccagtgaaacgtcaggtggtggcggcggaaacttgcaggtcgcccccacccccagcgccggctcccgccggcggccacttcggggaaggaccgcgcggagccagcgccggggtccccgggcggtcggaatcgaggcccggcgcgttgcgcaggccaggcccggcccggaggccccttgcccggcgcagcccccggccgacccccgtgcgccgccggcggccgccagcacggcgcggaggtgggctagcggcggcggcgcacgaaaggtcaccgcggtggcattcctctccgcgctgtttacgtgacttaatgtactcgctgcgccgcgggtaagttcgggctgcgataagggggcggccgggggagggtcgccgtaaaagccccacgccgggcgcctccagccctcccctcatccattaacctttttactttcttctccgctctctctccaagcctgttatctaggccacccaatgaccgacgaaagattttccctccctgcttctcccgtggccgctttaaaccaaataaatttagctattaagggccaagatgtctgacaaaagatcgaaaggtgtctttcc

SEQ ID NO: 461849 - DNA, 1818 bp, Homo sapiens
tctaacttcttaaggtgcaagcttaaagtgttgctgccagacctttcttctcttctaatttaccaagtgaagaatgttgaaatatccaactataatttgtggatttctcctttcaatgctatcatttttggtgcttcatgtatttttgaagctctattattaggctagagtgcaatggcacgatcttggctcactgaaacctccgcctcctgggttcaagcgattctcctgtctcagcctctggagcagctgggattacaggcgcatgccaccatgcccggctaatttttgtatttttagtagggatggggtttcaccatgttggccaggctggtctcgaactcctgacctcaggtgatctgccagcctcggcctcccaaagtgctggaattacaggtgtgagtcactgggcctggtcaggatttctttcatttcaactaactgttggcttattaaccctacttttttgttttaatttttagtggttactgttattttaatgtattagtcagatttttccagaaaaacaaaacctataggagatagataggtagatagatagatagatagatagacagacagaggaggatttactataaggaattggcttgcatgattatggaggctgagaagtcccaagatctgcagttgacaagctggggacccaggagcatcagtggcataactccagtctgaatctgtgtctaaaggctggagaagatcagtgttccagctcaaaaacattcaggcagggagagccttccactactggcaggagcgcctttttgttcttgtcagttcttcaatcgattggatgtggtccacccatattagggagggcaatgtgctttactcagtctattgattcaaataatgtcatgcagaaacacccttgtagacgtacccagaataatgtttaactgaatatctggcaccccatggcctagtcaagttgacacataaaattaaccatcacatttgagatttataatttgcatctttaacttatcacggtctatctgcaaagaatattatatcacttagctgggcgtagtgctgtgtgcctatagtcccagctactcaggaggctaagtggggaggattgcttgagccctgaagttcgaggctgcagtgagctgcgatcacatcactgctctccagcctgggctacagagaaagagcttgtctctaaaaaaattaaaaataaaataaaaagaatattacctcatgtatggtgatacaatagtatacttctatttccttctcttttctctctttctcttgcctgctgccatccgtgtaagatgtgatttgttcctccttgccttctgccatgatcgtgaggcctccccagccatttggaatttttccataatttactggaatagctcacagaactcgggaaaatactttacttacatttactggcttattataaaggatgcaattcaggaacagccagatggaagagatgcccagggaaggtgcatacagaattatggagaaatgatggtggatcagtggagcaactggggagctgctggggcacaggagagtgacaggacaggggctcagcatgcctccaacccaatcagcaaagcatccacacttccacagcactgtgctgggtgggaaagcttgttcttgccctggctgaaagacaagatgcaagcgatatagtgcttcatcaatgttgtagaccgaacatttatctctctccaaaatgtatatgttgaaatagaatctccaatgtgatggtatttggagttgatcgctccctgcagacttgtaggaaggcaaataataggttagcaccta

SEQ ID NO: 461850 - DNA, 1107 bp, Homo sapiens
gccctcggtgacacacatttatgccatctgctctgcggtacaccatgccacgtatggtctcattggctccacctcggaatttcccctgtccctgtgttcacgtgtcctggaaagtggtatcagctttcaagtgccccagggcttttcttttttcaaaggagaagggaggcatcagtgaattttcagctgacacctcgccttggggcccatgggatcattctgggatgcagcgaggccctgccttcctagcagatgtggtgagcccatcctttctcacccggaggggtccaaagtcggatctcaagaggagttctgggaccccagcaggcgcccagaagctccacctccaccccggaagtcggcttaaggaggtcctcaagaccggactccttggggtttggccttgggacgcctgtggcctcctctcccacgctgccccgtactggacccctgatccagccaccgccagggctgcaatgcgagccgcccttcctctgcgtagccgctattgtttaaaggggtcgcagcctgactgccaggagcggagtgcgactcggcccctccaatgcgcatgcgcaaggccctggcgcatgctccagtcacagttattcccacggttgtcttagaaacccgtccctgaggcttggcaaagtaggagccctccgtggcagtgcttgggtgtcggggctccgaggctccggcctgacctctccacggggtcgacaggaacatctctggctgccaggagtcgcaaagggccgaccaggatgacgaaaccacaggcgaagtccgggggaagcggcatggcatgccagcctcaggcctgccaggacggtgttcgggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaatgtttttattttgagttatttatagtttagaaaaattgggtgaagtgtgtttttgtgagcaaatttatttttctctaggttatccgtaatttgaaagctgtgag

SEQ ID NO: 461851 - DNA, 428 bp, Homo sapiens
ccagaagaatcatagatatgtttgaatacttattcattatttgccccagatagaaaatgtttgttaatcaaaaggcaaaagttataatgaggaagataatattgcctggggcaatgttgagacaaataaggtgaagatcaaccaaacgccctgagtcctttggcccaaatccctgctggggacccaaatacttttgatatagcatcttgctacctgaggaacgcaaggagaataatactcataagcagagcctctgttttcccataggactgactctaactatgtgaagaactgctacatattctacagtgcttaataggcggtgcctatctaacaggagctgtttggcttgtggatagcagttccaagatgaacaaatgacattgtgtttgaaagccactgctcttattaaagaagagtcaagcaaa

SEQ ID NO: 461852 - DNA, 2790 bp, Homo sapiens
  misc_feature (1)..(1): n is a, c, g, or t
  misc_feature (5)..(5): n is a, c, g, or t
  misc_feature (7)..(7): n is a, c, g, or t
  misc_feature (9)..(10): n is a, c, g, or t
  misc_feature (12)..(12): n is a, c, g, or t
nctcngncnnanaaaaaaaaaaaaaaagtacctggaaaaagtcgcagacagcgagcttttcgccagtgccaggaatacagataaaacgagagagactaagggagggagcgcgagcactagcgcgcgagagagagagcgagagcgcgcgcgccgatgacgtcacgctcggcgtctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggagggtctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaacttaaggtggctgggcttgctgcttgtccagtggtttgtatgtccagcgtcatctggcaatgtcatacctgttacctcttgactacttgtgaaggtagatgggggcaaggagtgttcctacttcagacagagaagtgggaccagcactaccacagacagcgccacggcctctgtgcatcgcctcatcagagcttccacccagctccctttgccgctcagtctcaccctcaacatccaccagcttcctccctctctgtcactgtctcctttttctccatcattcatttcactaaatcgctttccagattcacagactagaaaatggaggctgcctccccttcactggcagacccgtactcactgcccctgtccccttcactggcagacccgtgctcactgcccctgtcccctcactggcagacccgtgctcactgcccctgtcccctcactggcagacccgggcttattgcccctatggccacagctgttccttacacttgggctctggctcatggctccttttgcctgcccccgccatcctcctcacctgcccctcttgtacctttaacctctccccgtctcctggatcttcccccaggcctgtacctttcccatctcctcccatgtgcacctcctgtccagcctccctctcactgcgttatgtctgcagtgccttcacacaagctgtttcttttgcctggaatgacgcttcttcctccgttgaattaatccaccccgtattgcttcaatattcagctcaatcaggcccctcttgggagccttcattaactgttgggccagcagtgagctatagacgcactttccctgctccatggctgtgctcatatcacagtgggctcttaccatgaacttcctatcaacctcttgcactggacctcagacactctgaggacagagccccagtgtgattcagctccatacccctatatccacatgactcagctccgtacccctatatccacgactcagctccatatccctatatccacaactcagctccgtacccctatattcacatgactcagctccgtacccctatatccacatgactcagctatgtacccctatatccacatgactgagctctgtacccctataatccacgactgtccgtacccctatatcc

SEQ ID NO: 461853 - DNA, 780 bp, Homo sapiens
  misc_feature (3)..(6): n is a, c, g, or t
  misc_feature (11)..(11): n is a, c, g, or t
  misc_feature (13)..(13): n is a, c, g, or t
  misc_feature (16)..(17): n is a, c, g, or t
aannnncaaangnctnngcttggggagcttctggatagctgaacatgtgcagatgcctgaagcctggctcgcccaaaagggcatgaaagctctacgcccctcccctgcaccttgaccaattcatctcttccatccagcagtccatctgtatcctttgaatatcctttataataagtgggtaaattgttggaactgtatcctcttatcagttggaccatctctagaaaacacaaagggagctgcaaggaaatcctggcccactgctggactctaaatgtggctgacactgatccgttcagtgttaatcattggcgtatccttatattgtttcaaaattcagcatccacgtgactgggcctatataaagtttcccaagcgctttttcatctattatttattctgacatcagtgctgtgaagtatggcattatcaactctgtttgacatataaggagagacaggatcttgccatgttgcccgggctagtctcaaactcctgggctaaagtgatcctcccacctcagccccccaaagcgctgggattactacagaggctgaagtgcagtggcactatctcagctcactgcaacctttgcctcctgggttccagcgattcttctgcctcagcctcccaagtagctgggattacagagatgaggtcttgctctgtggcccggcgtggagtgcagtggtatgacgataggtcattgcagcctcaaactcctgagctcaagcaatcctcctgccttagcctcccaagttgttggaattacaggtatga

SEQ ID NO: 461854 - DNA, 1356 bp, Homo sapiens
  misc_feature (3)..(6): n is a, c, g, or t
  misc_feature (11)..(11): n is a, c, g, or t
  misc_feature (13)..(13): n is a, c, g, or t
  misc_feature (16)..(17): n is a, c, g, or t
aannnncaaangnctnngcttggggagcttctggatagctgaacatgtgcagatgcctgaagcctggctcgcccaaaagggcatgaaagctctacgcccctcccctgcaccttgaccaattcatctcttccatccagcagtccatctgtatcctttgaatatcctttataataagtgggtaaattgttggaactgtatcctcttatcagttggaccatctctagaaaacacaaagggagctgcaaggaaatcctggcccactgctggactctaaatgtggctgacactgatccgttcagtgttaatcattggcgtatccttatattgtttcaaaattcagcatccacgtgactgggcctatataaagtttcccaagcgctttttcatctattatttattctgacatcagtgctgtgaagtatggcattatcaactctgtttgacatataaggagagacaggatcttgccatgttgcccgggctagtctcaaactcctgggctaaagtgatcctcccacctcagccccccaaagcgctgggattactacagagctgggacctctatcctctcctgcccttggacatccatgctcctggttctcaggcctttgaacttggactgggacttataccattggctcccctggtcttcaggcctttgggtttgtactggggctacaccactggctttcctgggcctccagcttgcagatggcagactgtgggactcctcagccttcataatcccatgagacaataccttacggatagacaaaaggatatagtacaagccttgaagaaagttcagccgcagacttccttctacctgtggcgttctcccccgactcctctggccgccctcccaaaggatccctgtggtgccaggcaggaatgtcctgcttggggacccagtgaactcccagggcatttcccgctgcttcctgtacccctgtatttctctcgactgtctaaatggactcagccccagagggtctgtgggtcctcttgggattcctggtttgttcttgcagttgttctggagctaaaattcacaatgcaagcgtctgcatgctgctccgtccatttgagttggagctgcaatctagtcctgccttctatctgccatgatgattgccggaatcgccactgtttcaaaggaaatggcctggctgcccattggcccaaacagaactcctcaaagggcagcctaacttccaaagatacattctccctgcaccagaggcaggagagggactgacagggccaaagatccctgggggcagcccccataggccaagggccagtttccctttgtatcctccacaaactgcatgatccagttgttagcaagccttc

SEQ ID NO: 461855 - DNA, 1260 bp, Homo sapiens
ggggtgggagggcatattcagcatcacacactacccttcccagtaattcccccgacacacatacacacacacacacatacgcacacacacatatacacacccctaagttctactcaagagctggctctgcttctttcaacttcccagttctgaggagccagcttcccagctctgccatgcacttcctacccatctcaccctctcccacctgcaaagcagtaattcctcagtgccttgctaccagctctccaaagggcagaggaggctagacatcgcctctgatcaaggtactggataccttcttccccaaaaccactggcccagtggggcagaagagggcaagccttaagtggggtagaacccaaatgggccaattttaccaccataagaatcaagaaatgtcttgcttctgcccctctgtcaggatatctctagaatttaaagttagtgagaacagaaagcacatccttggcttacagtccacagggcctggcagtgcctcaacaggctggacactccttggacagccacatggactcctccttactgtggttagctgccatcaaccagtcctctcgccagcatgcagggtgggtttggcagcgccaggcacagcttcacatgccttccttgttcttctgaagtcccctctctggatggtgaccttgttcatgtggccatttttaaagcagaaagttggatcccaggccaaatcctgccttgcagttccgagaggcatgtgctgtcccccttcactggtgatggcgggccggggaaagaccccactgtggtcttacgaaaagtgtttgtagagaaaccaagcagcactgtatgggatggctgataattgctgctcttggtgttagttcctatctgcttaggcagaaggttgggactggggaggaggaatgttagtggagattttatgtaactgtaaacttcctctctactgtaagaaggattctcttgaaagaaaatgaaaaacagttccagatggtccatggaagatgtttcatggttggaaacctattctacctccttgtcaagaataactatgccttggctgggcacggtagctcacgcctctagtcccagcactttgggaagctgaagcgggagaactgctggagctcaggaggtcggggctgcagtgagccatgattgtgcacctgcaccccagcctgggcaacacagcaagattctgtctcaaaaaataataactataccttgaaaataggggtccatacttaccagcccaca

SEQ ID NO: 461856 - DNA, 1352 bp, Homo sapiens
gcctgtgcaccttccgcgtgtagttgtccagtgggcagttgagcatatgtgtttggctctcagaggaagtatctgggttggggaaataccagtgtggacaacttgtggagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatggcaagagtggcaaaagtggagtccagagagaacagaaagaatactgggatgagtttctgaatacagccagccacatccgggaagtggaaaagaacgagacattgcctccctctcagccttcaagatgccaaggtagcagagggctttggctatggccagcccattcttgcggaggacagttggcctgggagcaacacaggctgtaacagattcatgtgttctgctgaggaacagctggggagagaatggggtagaaggtggggaagttttgaccccaggaagcaggacataggatttcctgggattttatatcctcatcagtcctctgttactttcttgtggtacttcctaataataaattagcatccaactctattc

SEQ ID NO: 461857 - DNA, 1349 bp, Homo sapiens
gcctgtgcaccttccgcgtgtagttgtccagtgggcagttgagcatatgtgtttggctctcagaggaagtatctgggttggggaaataccagtgtggacaacttgtggagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccccccatcctgacgtccagcacacttttccatcggggaagttctcttcagagttgggcaggcacacaggctggatcatttcattgaacgtgagtggcccggccagcttcataagggcgatgtcattgcccagcctctgtggcttgtacttgctgtggcagacaatcttctccaccaagtgggatggggctggattgtccaacagggaaactagacccacctggatggtccatgacttggggaggtacaagtcataaacacagtgtgcagcagtgatgatccacaggggcgtgatgacagagcccccgcacaggtggtagtcctggaactgaaggctggcctgccagggccactgcgagagcaaggacatgtttccacccacgtatgcgtgagtctgtagccccttctatgatcacaggctgtctctca

SEQ ID NO: 461858 - DNA, 900 bp, Homo sapiens
agataagcaaggcctcgtaggccatgctaagcagtttagacttgattctcaaggcagtggagcccaacaggcagagaacccacatagttaattttttaacaaaattttttgtagaggcagagttttactatgttgcccaggatggtcttgaactcctggactcagatcttcctaccttggcctcccaaagtgttgggattatgggtgtaaaccaccatgcttggcccggttttccaaacttcttgtaccaatttacaatcctaccagtagcatttgagagctcccattacttcatgtgcttgccagtacttagtttcatcagtcttttcaattttagtcattctggtgatgaacacagaaaagctgtcttaacggatcagtacgagtttgccagacagaaggaaacttgggatgttgttgctgaggatgatgatgttaaaaataaaaaaggaagcaaaattgtagagcaggaatggatctgaagtcaatgaaaaactcttcatagctctagttgttgggcttccccagaagatgacattgaaaggaaggtttggatgcaagttgttcatttaggaggagatctcaggaagcacaaagtatttccttgagtcaggacctccaagtcctcccctaactaaatgcacagagggaggaccctatgaagactcagagagaagatggccatctgtaagctaaggagagaggcatcagcagaaaccaactctgtggacaccttgatcttggacttccagcctccggaagtgtgagacactgaatttcggtatataagccagtcaatccatggtacatggttatggaagccctagtaagcaaatacaaatttatgtccaaataaactacttgcatgtgaatctttgtctcatgatctgctaaagtagg

SEQ ID NO: 461859 - DNA, 3313 bp, Homo sapiens
aatctatggtgatagaaagccaaataattgttagggggtatggagggattgaccagagagctattgattggtaggagttacaatggggccttctgcctggtgcagccatcccggtggaacaaccccaggcaggagccgctcggtggccgaggatggcgggaagtcgctgggctgcggctggggcgggaggtgggcggaggagggtccggcgctctctttctccggattcggagccctaagtgtggatcagtcgcctcccgcccagggtgtgagcgccccctccccttctcagcctccttcggcctcgcccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctctcgcctatccccctcccggaccctgtcctcgcccgccactcaccggcgccaggggaacgcaggagcgtgagccccttcgcgcccccagcgccgtcggcgtcgctgccccagacacagacactgcctcgaagaggcctcacagaggcgggggcagaaggcggcgacccagagccgccacatcccccgccttgggcgccgtcacagtccccagacgccctggactcctgcagtctacgaagacgcgcgggggacggcgtggttccgagagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 461860 - DNA, 2457 bp, Homo sapiens
ccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaagtagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 461861 - DNA, 2583 bp, Homo sapiens
ccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaagtagtgtcttcttttgcaagctgggggaggggtttaaagatgctggcgctgccctctagccggctgctggggacatcaaaggagattcgggctgtggaaggctccctagcgtcggagatggagttaggagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 461862 - DNA, 1195 bp, Homo sapiens
gtttgataattcactagaatgattcacagaactcgggtccaagcgcaggagcttctgtccccctggaatcagggtgcaccaccctctgagtacatccatgtgttcaccaaccaagacgccgttgaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacagattagttggtcaaaaaagagtctctaaggagctgacaatgacaggaagcagccagccatacaaagatcagagcaaagagaagatggggcagagggaacagccagggaaaaggctctattgtggtagtaagtataagatgatctctgaagaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggaaactgtcagatagagacatgaagtgatgggggctttcatatgatttctaaacaaagcactctgacttctttgtaaaaccaatcaagtgttttatttctaagactaaaagcaaaataattatttctcatataaaattgattacttttgtccttaaaaaagaaaagaaggaaggagggaagggggagggggaggggggaagagagggagggaggaaggaaggaaagaaggaaggaaggagggaagggggagggagaggggggaagggagggaggaaggaaggaagaaggaaggaaggaaaaagaaaagagaaaagaaagaaacacaaaacctactgatatggtagctagtatttcctgagtgataggcactactctggatactttactattctggttatttaactaagtcattacaagaaccttgtgaatgagtgtccattattatttccatttaatagataagggagctaaagccactgagtggttaaggaccttggcagaggtcacacacggtaaacaccagagctgggatttgaacctaagaggcctgcttcccacacacac

SEQ ID NO: 461863 - DNA, 931 bp, Homo sapiens
aagaatgagattttatattgtgtttaatgtctaatcagttaaagtcatttacctattttatttgcaaaataatttttggcaaagaggaacatttttacatatcttcctagcaataagaatgtgttcaatgtttacaattgtttggttacttatgaccccagatgtgagattatagtaagtgattatcacaacgttgttgagacaaatcagcctcctaagacaaagacactttacattaattgaacaaaacacaatcttctgaaatagtctaacaaatgtaatgtctcaaatttaacacctgcggtctgaaggttttatgtcacagtccttgcaattattaaaacaaacctttcgatattacagaaaatctctttgtcctacttgggtgataatataccccttaacataataaaggagttaatgcacattaaatacataaaatacttacatcagtgcttgatgaaaggacaatttaagtgtcaggtgaaaaggaaagaactgtggcccttcagggaccccagacctgggagctccccaaccctgggttgtgactccctctttggggccctgcagttcctggagtctccaagcttctgggcaacaccacattccctggtggcagccgtggaagctgcttgcagggtgcctggtccagctgcagccttgcagagagtcggtgcctgtgccagcacctgcagctgccctgccctgcagcagcagccagtaaaatctataggacttggtgatgaattctgttttgacgatgacgtggatgattcccaagcttctgacttgggtcactgataaggttagcctttgtgtccccacccaaatctcatcttgaaatgtaatccccaggtgttgagggagagaccttgtgggaggtgattggatcatgggggcagtttccccatgctgttcttgtgatagc

SEQ ID NO: 461864 - DNA, 1479 bp, Homo sapiens
tatgaactttgttgacgaatgtgttctctgcacagctaacccagagaattcattccaccctcaggagaagccctagaagtgatacaggctctggccgggggacccgatgtgctcgtgtcgcggcgtggggcttggtgaggaaccaccggagtgctcttgcatttttcatgacaaagaccacacagttggcctcattcctgcacagtgggagaatgtgtggaggtgtcccgccaccagagaggaggtctatgtcagcaccatcaccagcatccaggctacctacaagaggaggcagggggactcctctgacacacctggggaggtctcgtcaatggcaggttccctctacaatgctttctctgctgcaaatgcaactcagcatcacctctttcctggatataattccaaggaattattaaaggaggcattggtgtcagcacctcgtgaaatactcgtaaggatgacccatggcagagcctgtgtcttcattggactggaaggaaggcagactctggtgaagacgtgggccgtcaccgtcagccttcggtacttgaagagtggttatccctgctgtgttcgcttaatttatgacgaatcatacagggacatccagtttttcagtatcaaatactgctttggaaggcttcccggacagcgtcccgccttcaggcaaggggtcttggcttcacctcccacccaagtaccaaatgctacctctaaggacttcctggacacaatggcagcttcaggaaagatagtctttgtgtcaaccatgtggaaaagccaagaatggatggcgggccatggacaatgcgctgacctagctggtcccatccaccctcagaggccactcccaagctgcccaggctgtgcagaagatgcaggaatgctgcgagcagtgccacctcatggtactcggagggaggttgtccgtggtgagttcgcattatttaatgatgcccaatacacggtcgacctcttttcggtatcagatctcaccaggtgtcttcttggacctgatgccgatttaggggacaccatactcattgtcaccttccaccctggcaggatgccttatggcaatgccacttctgagatggtcgtgggagtcagcaccactggccagggggacttcctggaggaggccaactttggagaacaggcattgacattgggtctgcgctagcgtgtggtacttgaagatagagctactctgtggtactggtggagaggtcttccatgatgcattcgatttattttttgaccaatcctacatagtggactcttttgaaagcattaaatctagccttaaagcaccctcgggtggtgccgagtttaggaactagaactggtgtctgaatgcctgaacgcacggcgaagctgacagtgtgcacactcttcttggtgggtcgtgcacctgcaggcgtcctgcttgcttaccatggcagtttcctcgaaagaggcggcagttccctcatc

SEQ ID NO: 461865 - DNA, 4474 bp, Homo sapiens
cctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtaacacagctgtttttatttactcccgtcggactataacgctgttgtcataagggatgccccatttatgaatgacagagtttcaaaacgatgtcatgtgacttgggaatgccacggaacatccagacctgtagccattgttgacatttataatgcagcttttcttctttttctgagatgatctcaagcctcacacactgttctttctctgaggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctccactgtgctgctgacttgtctctggttttctgcagtgtggggagcccagggaggtggatgaatgaacagttaccatgaagggctttggccttatagggcttgtagggaaagaagcaaagtgtttggttggggagggaagtagggaaaaggctgccacctccccccaccaaggtacaactgctgacttccttcctccccagccctctatcactgccctctgtgccgctgccgttgactggcctgccccaccagactgagggctctgactgcccaccgagtctagtgtcagcattatggctgacccagagcaggctatacagttagtatgatggataaataaatgattggtcagtgcagtcaattaggtgcaagctgttggtagtaggcaaggtcaatgaaggtcatccaagcctgggcgacagagtgagactctgtctgaaaacaaacaaactacagctggctgtcctattcttagtccacaatcccttcctccaggtactttctccccttagtcacacagcctctgaaaagggtttgtgtcccaacctaccagaaacctttttaaaaatctattcacacacacacacacaagttttatcaagataaatcctccataccacgggatgggcttttacatttctcaaccggaagtttgccatttcaggctgaatctctgcaatcaagattccgtttatctcacttggcttcctgagccaggactcaggtgtactctcttccctaccccaggagcatcttccagcagcttccctgacctgcttgtacaaatgcccccttccagctgcagagccacaggccacccatggccggcagtggtgtccctgcttcctgctatcaagggcagagaaatattaaagttcaatctcagaacaccctgttatctggtcaagaaatttttaaactactttttatagtaaaaaattaatatgaacacaacctttagtccccaaaccatccacaccgaaagggaaccgctgtcaacagtttcttacacattctcctagaaatattatataatctagaaacattatgtaatagatatccattaactgtattacatatgggagcatactatgcacattttctgtgcttgattctacctacccccctccaccaattaagaatttatttggagatcattctatttcaggacatactaagtttggctaattgtttttattcaatagttaatgttagttttaaacggatgtgagatt

SEQ ID NO: 461866 - DNA, 669 bp, Homo sapiens
agagtgagaccctatctctacaaaaaaaattttaaattagccaagtgtggtagcatgtgcttacagtcccagctactccagaggctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatga

SEQ ID NO: 461867 - DNA, 1482 bp, Homo sapiens
acgcattactctttaaacatggcgccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgctt

SEQ ID NO: 461868 - DNA, 1535 bp, Homo sapiens
acgcattactctttaaacatggcgccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatga

SEQ ID NO: 461869 - DNA, 1570 bp, Homo sapiens
acgcattactctttaaacatggcgccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgaccggaaacaaaaaaaaagttggcggcctcgtgccg

SEQ ID NO: 461870 - DNA, 1682 bp, Homo sapiens
acgcattactctttaaacatggcgccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagtctgaagatgccaccaacatcaaagggaatggagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatga

SEQ ID NO: 461871 - DNA, 670 bp, Homo sapiens
gaaaactggcttgtgatccttcagaaagacccataattaggtcctttaaaaatgacggtcaagggaggagtccggggaaaagttgatagacccagggtggctacggtcctgaaagtgcacaatgcgagggataaacttgtagcacagattgcaggcctgcaggcatccaaagatcaacaactatttgatggaatcattgttgggtctcctggcagaagtatttctccttttggaactaagaccttcaggcaagcagagcataaggtcacaggaacaggagggcaagtgcttcaagatggtgaggaacatgataaaaccaatgaagtccatgaacataagcccatcgccacacttctttgctatgaaaagcaaatgaatatattatctgtccgaagcaagacatggggcaaatggatctatgagtcgtgggtgattgggactcctcgctcgcgtgggggtgtgactgtacttcagaactcattttcaccgatgctgacatacaagacagtcctcggagacctgtctatcaaactgcaacatgctctgcagaaaaattagattactcatgctcagacagagggggcgatggcaatttagagtggccccttaaatgccaattacacttgtatttacaaaacaaattaaacccacgtataggacattgttcaca

SEQ ID NO: 461872 - DNA, 4860 bp, Homo sapiens
gcagtagtggcagctgggaccgcggttcagtcaccaatatgcagctctttgtccgcgcccaggagctacacacccttgaggtgactggccaggaaatggtcgcccagatcaaggctcatgtagcctcactggagggcattgccccggaagatcaagtcgtgctcctggcaggtgcaccgctggaggatgaggccactctgggccagtgcggcgtggaggccttgactgccctggaagtagcaggccgcatgcttggaggtaaagtccatggttccctggcccgtgctggaaaagtgagaggtcagactcctaaggtggccaaacaggagaagaagaagaagaagaggaagaagaagacaggtcaggctacgcggcggatgcagtacaaccggcgctttgtcaatgtcgtgcccacctttagcaagaagaagggacccaatgccaactcttaagtcctttgtaattctagctttctctaataaaaaaaaagccacttagttcagtcaaaaaaaaataataataaaataaataaataagactgcagaactgccttgaactgctaacctctgtctctgcaggaacagtcacgaagctgtcacactgctgcttcagttaagctgtttcctctggcttgcccttgaattctttcctgggcaaagccaagaacctcacaggataagccccactttggggctcacctactctgcatccccctcacaccaggctggcagtcagttcatggcctgggtttggaatccaggtgattgtaggcagcaggtcctaggacctgacccccagtgctcctcccctggcctcgtggccatgttatctctgactttctcagaatgcaggcagaccacactaggattcattccatctcccacggtctaggaaaacatttgaaagacaaagattaatgactagggttagggatccgggaaggaaggcgaaaaacaagaggaaagaatttgttggtgggtgtcagatggtatctggagcctgcaggaactgcatcctctacaacgagctgagcagacacttcctgaagagctaatttcaccatgaggcaggctttgatccagttaatctggagaagttgtgaagatcacaggttcatcatttcctccccaggttcagactctgtcacaatcaagagaaggaatggaatggtgagtgtcatctctctggacagtctacggaaagccccaggaccaggcttaaagagcctgggccctgctggcagggaggggaaggcagctctgcctttgtgatttgaacaaaaccaaggctgtcctcaccgagcgtagctatgtcacttccactgctttcctggcagagaaatgggctgtgttccccaaactccatgcagagagctccaaccccaaccttggcttcctcaaactgaaaccaggttcaggaactgtatcctgctgggggtgcccaaactaaatctgacaaaggaagggccaagactccatggatttaggaaccactgtcattgaagatgcactgtgctttggggaccatcaaccgggctggcaccgtcaaccaggagcacctcaatggcattttcaggcctattctgcctgtgacccacagtaggtcctgcatggattgactttggggacccattgcaggtgctactcagccctctctgccctcagggagtcaacacatgagatggagttgtgcagtgccaggtacctccatgccatagacatgtctctgggaagttgcatgtacatcaaaccatttgcctacctgctgttggattttccagtttctgaatctgctgttgcatccacatttccaggttccaaaaccctacccattctctgaggcacaactgcagcctcacccgttgctaacactttcctggcagcctcaggcagcacaccccatcagctttgaactggtcccagcaggcccaaggggctgatgaaatttcattgcactccaagccaggaattttaaagccttccccagcctctttgtatctggtcattgattaacattttactggcaatgccttgtgtgtgcctacatatttatttctaacatttatattctcaattaatgagaaacatactaatataggacccagacaatacagagaggtgtgtgcaggaaacaggtgactttgtacctgcagatccttttcatttttgttccttctgtaaacaaccattgttctggctacaaaactaacaacaaaagaaaagtatctagttaatttcatgtaagaagcaacactgcactttttttggctggttgaactagcacaataataaataacatatataaaaacaactcatttcaggatctcagaagttcttttaatattttctcaggtgctgggtctgaaaagaaaaaaatgaaataacacgagaatggccctgaaggagttgatggcctgggagggaggtggtacacccaagtaaatgtgagatgacagctgcgtataagctccatggacgtgagaaaagggggagcagtggaggtgggctttagagctatgccaccttgagaaacgcatttctggccaagaggaaagatcacaaaggcctgggagaagggctgactccctttcccttattaggactccataggtgggagagtcagaacgcagtagctaagaggaaaacggtgctgagaaaatgcagtgggtgcagatgaactgcagctcagcttcaaatctaggttatcaaatcttctcagagcaaaattcattttggtttctgcttacctttttggttttagacaggtaattccttatattattttggttctttgatgtttctataaactttaaaaaatccgtcatgatgagctgtggtccatgagaggcaaatttgaataacctaggctgccaatggccccagcagaaagccgttagttttcaaattctgattcagacctaaacaagagtttagaactaaagaggaaaagaaggtagtgaggctctctttgcttaatatatttatatattgcttaatatgcttatttgttttagtatggcaatattggtaaatagcagaactagaaatgaatttgaaaatttatataaaatttttattctcagaaataaaactttgttgttctgtgagttatcaggagaataaaaaaaaagactccataatggtttaaacagtttgtttataaaattccattatgttattcattttagctaaatgattatactgatgtgtgttccctctaagcactgacccaggactttattttaaggcagcttaactcatgttcttcagagatttgaagattttatttcaaaattattttagtggtgaagtagatatagaataaaccacacaacaattatgttttgccaattttctccttgaggatgactgcagatttgtacttcttatgcaaggaatacaggctgttaagtagaaataattcctttcgatgctttggaaagaagctagtggaacaaaatttaaaatattgtgtgtatactctctatataatttcatagtatcaaagtgtataatatataacctttgaatgcaaatagcaaaacatttcttcagtatttttaaattcagggatttcatagtacaatgaatatatatatattagtaatcaggatgatctttgtggaatacaataaaacattaatgcattttattttttatggaaattagaaaaaattttactgcagaaaacaagagtaaaaatatatgtaatatttaaaaattcagtcatattactcttcaataaactgactacttatgagttttcttctgttaatattaagtgtctattcataacacagcagccagaaaggtcctgttgaaacctaagtcagatcacttcacttctttggcctcaaccccatttcagtcagggtaaagcgaatcctcctctctgctgcttttactctggcctgggctccccctgaaacattttgcaaacacacaggttgttccttatgcctgggaagcatatccttcagatgacaactccatgtgctctcttcgttcaagtctctgctcaaggaagcctcacccttactatttatcttaccttactctgtttatttttccactgtacttgccattttctaatgcattatataatttaattacgtatgcttatcatctgtgtctgcctgctagaatgtaatttcagtgttcacagatatatttcaagtatctacaataatggttgcacatagcaaatactaaaatatgtgtcaaatgaaagaataaaacttttgagaataaaagttctgtgaagcactaaggacctaaggtagtttacatgggtccagcagcaaatgtatgtgaagaaatggaaccacagagggaaagaaatttgtaatttatctaagcctttccattcctatacagtcactctgacatatgaaaactacatctattagaaatacctttattattttcaattttgaataagacactatgtaacgtacaacaaagtgaacattttaaacatcaaaacataaggaccatgacattcttaaatatttataaatactgactattcctaagtatcaataaatacccaatatattagcagtttcagcataataccccatcatatgcaatttgaaaacagagcaaaattggtcaactggttagtcaaataaaagctaatcattaacaagttcattttttttttacctttttactacaataagcaacaaatgcaaataaaaatgtgtaattatgatatataataaaaataaaaacaaatatagtaagcaaccaatactgtgaaacctaatatatgagtatatgagaagcacttttgcattcctagaaatatgattcttggcatttattttgacattgccatatattttttaaagtaatc

SEQ ID NO: 461873 - DNA, 1182 bp, Homo sapiens
ggcacaggctccaactcgggctccaactcttagtaaccgaatgtaaggggctcgttggagaaggtaggcaggcggcgccattgtcacctctgtggacctgtctactgtccacacatctggactttggggacaccactttctggctctttcagaccacacacccccaacggccaggacacacaacactgtctggaagtcattcaacagaaccatgaaagacgtgtatctaaagaccatgagggcagtgctctccgctatatcccgggggctctattctgcatgtttcccaccactattacccatcacagaagctggcactgaacgggaactcagtgaattgtgggtggatgaaaagaggccaagaacattcagtgaccgtgcccaggtccagacaagcccaaccttgttcattcgctccacgcatagctacagaacacaaagaggctttgtgacaggcctgcccttgatgcttacggagaacaacagaggaaaaagttttgatgaggagggaattgtccccagagccaaatgctacggaaaggtcagagaaattgggggtcgagaagaagccattggattgggaaggggaaacagcacgaagttacattgggaaggacagatttgaagacagagtgctcaccgccacagggctggctcaactgtgagaaatgttttccctggagatctgacacagacgtggcacagtgttggggtttcaatggggcttcctatgtttgtctgtagaataaagtttttttttttttttaagacgaagtctcactctgttgcccaggctggagtgcagtgatggttttacaggaccttggtttaaaagtaactagacacctggaagtactcccagggaggtgaaaaatatccaaagacaaggatccagcctgtggatggagactggaaagtggctgcagttatatcacacagagagtgctgcgatgcctaggaggaccaggtacgtgtgccctgtctctttcagaagcttcaggcctggcttcaggcttctgtcctgcttggcattcgcctgtggtttccaactcctccgaagtccagcctttgctgctgtgcggggattgtctgccctctactgtccatcgtctgtcatggcacacatttaacagatggccaggaactcaagagggggcactaattgggagaaaacttagagac

SEQ ID NO: 461874 - DNA, 2205 bp, Homo sapiens
ggcctggcttcatcacggattagtgttcttataagaagagacaccagagcatgttctttccagcctgtgaagacagagcaagcagaaagggagcccacaccaggacccaaacatactggcaccctgatttcagacttccagcctccagagctgtgggaagtaaatgtctggtgtttaagccatccaacctatggtttttcattatggtagcccaagccgacagacagtatccaaatttaggcttccagtactttagacacatcatttggatctcatattctgaaattgtaaattatgcctttcaactagatgttagtaagaacctggtacaatggagaaaaatgatgaaagattttcctatgggcaaggcaagccaaacaggcagtggtgctggggacttgcaagagctaggagaatgtattcttccatgttctttaaagaggaaggagacaatgagctctatacaaagtcgcccgcagagaacacaaaggctttctgcaccctggcactagtaatctgagacttttgcccagattttaaaactttgcaatccatttaaaattatgaactagaagcagtgtttgcaatgcttttttatttccgtactataaataaagtactataaataaatggctgtacatttaagtctttgaaactttaagtgcatttaaattataaggcatgggcatgaatgtataaacagtgctgatccaattggattatggattgagagtgtgtgttttagttctttatttttttaaacatatggacttggaaaagcatggatggccttagaggagaaaggaatatgtgtagagtgggggaagcatattcaaattccagataattgcagctttgtgaggttatactcttttacctttcagtagtggtttaacaaaggggtgtcagtagcaaagccaaatttctgggctttggagggtatttattagagagagagggaaattttcatatgttcggtaagctgaaaattacgtcaacatacttgtggtataaatgagttgtggttcttgaagactgtaaagctgcgactcaccaattcgggatagctgactttcttagctctcatcttccattggtaggtgtgtgaataacttctttatcaccaactaaatagtcttctaggactttatcacccttttcataagattatgtgtgtcctggtggcgagaagcctgagccaagttttgcaatacaaaagcatgtaaggaagcattctgaagacagtctaataaagaaatcatggtgtccatatatcagtttttctgtattcccgagtattcatgcacacgcataaacatgtcgtaagatatgggtatttatatgaatgattgtatgcataaatgtttgtatataaaaaggcatgtttacaatcttcattctaaccttcacatttcctaaggaattactgtattcaacagtcaccaatggcagcgcctccgcgtttgatgcgggacgttcctgtgggagggagcggctggatcacagttcggtgtgcggctggctctgctcacatcctcgtccttggcattacagcgtttcttcacaaatgactcttgaccgacaagcaaacaccaccaggcatctggatgagcggcgtgtcctgctgctgattattttgaaatagcagcgatgttttgaaacaggcatgtctccgttggcagataagaaagacgaagtgaagtgaggcaccagcacaccacagtgctccgtcaagctcttgtctattaaacaaacgacatatcccaaattctactgatacatgaatcaagagaagcttctcaagttatagatctcagagtaaatatatataccatcctatcccaatccatcttgctctaaatactgctttttttgaggctgtcaaaagcacaagctgccatggtaatgacaggaagatatgggtgaaatgccagccctaattagagacttgattgctctgtaataacaaggcctgtatttgatttggacggttctgggttgtcaggtaaaatgaattaaatatgtctgcactttcatttcaaaatgtgaaaaatgtgaatgtgcattatttatattgtatttcatggctataattaattatgtgtctgtggacatgatgtcccaaagacagttgattttatgttcaatctgtatgtgcatttgtaaaactaatttgttctcattaaaatttttaagggtttattc

SEQ ID NO: 461875 - DNA, 371 bp, Homo sapiens
agaaatgcactcctattctgtacctttatacagtggtaagagggaaacggtttacatgtgtaggtggacaaagaagaagagtttaaatgaagcattacatagttaaataaatacgggcccttagtataagaatgcaaatgtggagaagacttgcttgatagggaaagtaaaaatggcctcctctcccatgtactaatagccgtaaatactttttcagggcccacagcctgtcacccacagatcaccaagcagctttctacctggctctgcagcttgccatctccagacaggtcagtttctctaatgtttcctatacttgctgcactctgtatcttgatacaactccttcagctcttcagtttgaagtggta

SEQ ID NO: 461876 - DNA, 2216 bp, Homo sapiens
tggtggagggtgcagggtcctgggctcctagacgacacctggtcatgcacaccctcctgtgaagaagaggagtcggggtggactatggtcctccctggctggcctgagggtcttctctggaaacaggactgaggtttaactgagagtcactgctgtgggtgtccctgccctgttacacccggctctctgcctctccacgcctgcacctgcgcagcagcgtccctggggagtacccgtcaaccctgttgactacttgcaaatggtgaccaaagaccgggaggagcaccgccgctcttcagaccgggctgccacagccttcacttctctcctgacccttcccttctgcaggcacgggcacaggcaccctagacttccctgctaaaggctccctgaacccccatcgctgtctaaggactggcccagccccctgcaaacccttccctagcaaaccctcagtccattgctgctgatggaactgagcgctctccacatcttggcatcacgactctggcgcattcccccagcatcaggagatcagagaaacacaaaggccctgaatccgcatagcacttgggtagcagtttttacacctctctgcaactatgaaacccattgtttaaataaaaatttggcaagcctgggatgtaaaaccaaagcagcaggagaagtgcagggtctgcggattctgcaaaggccctcagttgggttctgggaattctgtttggagaccgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaagggtcacgctccgttgccaggctggtgtgatctcggctcactgcaacctctgtctcccaggctcaagcgatcttcccacctcagctgggactacaggcatgcaccatcctgcctagctaatttttggtattttttctagagatgaggttttgccatgttgcccaggctggtcccgaactcctgaactcaagagatcctcctgccttggcctcccaaagtgctgggattacaggcatgagccactgcacccggctttattgttcttaatatagacaaaatacatgtgttttatataaaattcagaaatgatgactaatcaaaagaacataaagatatccattacccatctactcaaggcagttgctgttaacactacagtgcatttccttccagatcttctctacacctcctgtatgtgtgaatttttttatataaaagtgggattataccacatatactgctttgtgacctgctttttctacttcactatagatcgtaaacactttccatgacagtatataactttctgcaacatttaagcagctgtataacatttcatagctgtttggaaaataaagaaatatatatatatttctttatttataatatatatattataaatatatacataaattatatatataattatatatttatataaaatttatacatataaatatatatttatatataaaataaagaaatatatacatatatatgtatatacttaatatttatttttaaatatttataaataaagtcagagtttcttgtagacggcatatagttggatcatgttttttaaatccattctgtcaatctccatcttttgattggagagtttaatccatttccatttaaagtaggtactgataagggacttacttctgtaatttgctatattttctacatgccttatagcttttttatcccttgctttctgcattattgtcttcttttgttagttgattttttttgtagcgaaatatttaaatttctcatttccttttgtgtatatttgctagctattttctttgtggttaccatgaagattccatttgatatcttaaagtttaacactctaacttaaatgtataccagcttgactaacatacaaagactccattcctgtaaagctctatccccacccctttctgttacc

SEQ ID NO: 461877 - DNA, 694 bp, Homo sapiens
caacaaaaatgtattgagcttattattgaagtagccactcattacaagctgaaatgattctcatgtccccaaatttctctagccttggttttccattttgattttggagctctggccttcttcccatttacatttcctccttggtttgattacagagggacagatggcaatattaaagagccgagaatgtggttcagagtcatagaacaggacgaaaccaggtgcggtaagcttgtacgttagaatgtacatttcagagcctggaaaggtgctgccatggggcccaagggggaactggaacctatcgccaggacagagggtcgagagggagggttgaatgctggcgaatcagcagacaagccctggaaggaggttcagcaggaggaggataaaaccagatagaaaagataggagagaagaaaagatggaagtaggtcaagggaagagtagactatgtccccatgaaaagtggtaggctttcctgccagtggaaaaacaaggatttgaatgagagcaaggctgtgggactctggcctgagctctccataatgggctgaggacagtgatgttggtgagcggaagcagagctttgcctgtcaggcggaacgagcagctggtgctccggggacctgcaggccctttcctccttggtcccagccgagctgttgggaacgattccaagtggaaggaaatg

SEQ ID NO: 461878 - DNA, 3005 bp, Homo sapiens
tggtggagggtgcagggtcctgggctcctagacgacacctggtcatgcacaccctcctgtgaagaagaggagtcggggtggactatggtcctccctggctggcctgagggtcttctctggaaacaggactgaggtttaactgagagtcactgctgtgggtgtccctgccctgttacacccggctctctgcctctccacgcctgcacctgcgcagcagcgtccctggggagtacccgtcaaccctgttgactacttgcaaatggtgaccaaagaccgggaggagcaccgccgctcttcagaccgggctgccacagccttcacttctctcctgacccttcccttctgcaggcacgggcacaggcaccctagacttccctgctaaaggctccctgaacccccatcgctgtctaaggactggcccagccccctgcaaacccttccctagcaaaccctcagtccattgctgctgatggaactgagcgctctccacatcttggcatcacgactctggcgcattcccccagcatcaggagatcagagaaacacaaaggccctgaatccgcatagcacttgggtagcagtttttacacctctctgcaactatgaaacccattgtttaaataaaaatttggcaagcctgggatgtaaaaccaaagcagcaggagaagtgcagggtctgcggattctgcaaaggccctcagttgggttctgggaattctgtttggagaccgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatggagggacagatggcaatattaaagagccgagaatgtggttcagagtcatagaacaggacgaaaccaggaacttgacaagaggagtcggaagatttagagagcttctcagagcagttgaaacaagaacaactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccggacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggcaactctccagaagcatactttcatggttttccttcccttttttcagttagctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatca

SEQ ID NO: 461879 - DNA, 291 bp, Homo sapiens
caaggtcagtggaaggggatttgaatagtcagatctcatggacagctgaggctgggagcagcaggtggctgtgatggccttgcccctcctgtccctgaaggccctgcctgccacgctccttagctgagctagccagcaatacttctagctgtccctagtattgatctcttgtttcatcccccacaattttattttattgttcttttaaaaaatttattatttatttacttttttgaaacagggtcacgctccgttgccaggctggtgtgatctcggctcactgcaacctct

SEQ ID NO: 461880 - DNA, 297 bp, Homo sapiens
tttgttgcttaccacacacaagtgaggaagacggacaggcagtatgtcccttgcaggtcagggactgaggcgcaggagttacaggagctgccggtcccgcagctgttgaagtcagtatgcagtcagggtctcctggctctaacacagtttctcctgccccaccatactacactgccctcattttattcttgttacaggtataatcacaaaaatgaaatcatctggaagcatagccccatgatgtgaaatccagcatgggtattgatcctgtcactttaaatatatctgagttacact

SEQ ID NO: 461881 - DNA, 2954 bp, Homo sapiens
tggtggagggtgcagggtcctgggctcctagacgacacctggtcatgcacaccctcctgtgaagaagaggagtcggggtggactatggtcctccctggctggcctgagggtcttctctggaaacaggactgaggtttaactgagagtcactgctgtgggtgtccctgccctgttacacccggctctctgcctctccacgcctgcacctgcgcagcagcgtccctggggagtacccgtcaaccctgttgactacttgcaaatggtgaccaaagaccgggaggagcaccgccgctcttcagaccgggctgccacagccttcacttctctcctgacccttcccttctgcaggcacgggcacaggcaccctagacttccctgctaaaggctccctgaacccccatcgctgtctaaggactggcccagccccctgcaaacccttccctagcaaaccctcagtccattgctgctgatggaactgagcgctctccacatcttggcatcacgactctggcgcattcccccagcatcaggagatcagagaaacacaaaggccctgaatccgcatagcacttgggtagcagtttttacacctctctgcaactatgaaacccattgtttaaataaaaatttggcaagcctgggatgtaaaaccaaagcagcaggagaagtgcagggtctgcggattctgcaaaggccctcagttgggttctgggaattctgtttggagaccgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatggagggacagatggcaatattaaagagccgagaatgtggttcagagtcatagaacaggacgaaaccaggaacttgacaagaggagtcggaagatttagagagcttctcagagcagttgaaacaagaacaactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccggacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagagggcccacagcctgtcacccacagatcaccaagcagctttctacctggctctgcagcttgccatctccagacagatcccagaggctctggggtatgtccgccaagctcttcagcttcaaggtgacgatgccaactccctgcacctccttgccctcctgctgtcagcacagaagcattaccatgacgctctgaacatcatcgacatggccctgagtgaatacccagaaaatttcatactactgttttccaaagtgaagttgcagtcactctgccgaggcccggacgaggcactgctgacttgtaagcacatgctgcagatatggaaatcctgctacaacctcaccaaccccagtgattctggacgtgggagcagcctcttagatagaaccattgctgacagacgacagcttaatacaattactttgccagacttcagcgatcccgagacaggctccgtccatgccacatcggtagcagcctcaagagtggagcaggcactgtcggaagtggcttcgtctctgcagagcagtgcccctaagcagggcccgctgcacccctggatgacgctggcacagatctggctccatgcagctgaagtctatatcggcatcgggaagcctgcagaagccacagcctgtacccaagaagctgccaacctcttcccaatgtcccacaatgtcctctacatgcgcggccagattgctgagctccggggaagcatggacgaggcgcggcggtggtatgaagaggccttagccatca

SEQ ID NO: 461882 - DNA, 2464 bp, Homo sapiens
tggtggagggtgcagggtcctgggctcctagacgacacctggtcatgcacaccctcctgtgaagaagaggagtcggggtggactatggtcctccctggctggcctgagggtcttctctggaaacaggactgaggtttaactgagagtcactgctgtgggtgtccctgccctgttacacccggctctctgcctctccacgcctgcacctgcgcagcagcgtccctggggagtacccgtcaaccctgttgactacttgcaaatggtgaccaaagaccgggaggagcaccgccgctcttcagaccgggctgccacagccttcacttctctcctgacccttcccttctgcaggcacgggcacaggcaccctagacttccctgctaaaggctccctgaacccccatcgctgtctaaggactggcccagccccctgcaaacccttccctagcaaaccctcagtccattgctgctgatggaactgagcgctctccacatcttggcatcacgactctggcgcattcccccagcatcaggagatcagagaaacacaaaggccctgaatccgcatagcacttgggtagcagtttttacacctctctgcaactatgaaacccattgtttaaataaaaatttggcaagcctgggatgtaaaaccaaagcagcaggagaagtgcagggtctgcggattctgcaaaggccctcagttgggttctgggaattctgtttggagaccgatgacatggcagagcttctcctcggggagtcgaagctggagcagtacctgaaggaacaccccctgaggcagggggccagtccccgaggccccaagccccagctgactgaggtccgcaagcatctgaccgccgccctggaccgagggaaccttaagtcagaattcctacaagaatccaatctgatcatggccaagttgaattatgtggaaggtgattataaagaagctctgaacatttacgcccgggtgggcctggacgatctgccactgacagctgtcccgccctacaggctgcgggtgatcgcagaagcctacgctaccaaaggactttgtttggagaagctgcctatttcttcttctaccagtaatctccatgtggaccgggaacaggatgtcatcacctgttatgagaaagcaggggacatcgcactcctgtatctccaagagatagaaagggtaatactttctaatattcaaaacagaagccctaagcctggccctgctccccacgatcaagaactaggttttttcctagaaacaggacttcagagagcccatgtcctctatttcaaaaatggagggacagatggcaatattaaagagccgagaatgtggttcagagtcatagaacaggacgaaaccaggaacttgacaagaggagtcggaagatttagagagcttctcagagcagttgaaacaagaacaactcaaaacctgcgaatgacaatagccaggcagctggcagagatcttgttgcggggtatgtgtgagcagagctactggaaccctctggaggatccaccgtgccagtcacctctggacgatcctctccgcaaaggagcaaacacaaaaacctacactctcactcggagagcccgtgtctactcaggagagaacattttttgtcctcaagaaaatacggaagaagccctgttgttattgctgattagtgaatcaatggccaaccgggacgctgtgctgagcaggatacctgaacacaagagtgaccgcctcatcagtctgcagagtgcatctgtggtctatgacttactcaccattgctcttggaagaagaggccagtatgagatgctgtcagagtgcctagaaagagccatgaagtttgcctttgaggaattccacctgtggtaccagtttgctctgtccctgatggctgctggaaaatctgcccgtgccgtgaaggtgctgaaagagtgtatccgcctgaagccggacgatgccaccatccctctcctcgctgccaagctctgcatgggctccctgcactggttggaagaggctgaaaagtttgccaaaactgtcgttgatgtgggagagaaaacgtcagagttcaaggccaaaggctacttagctctggggctcacgtacagtctgcaggccactgacgcttctttgcgagggatgcaggaggtcctacagagaaaggcgcttcttgcatttcagaggtataatcacaaaaatgaaatcatctggaagcatagccccatgatgtgaaatccagcatgggtattgatcctgtcactttaaatatatctgagttacactgatttcttggaactgtattagaaacttagttacgaatatttcatgaggccttcccaatacctgacaagcttcgttagactctttccttagaactggggctgcctactgatttatcatggtgtccgtatgccttttttcatgaaatcatgatcagtggtttcagtgagtctg

SEQ ID NO: 461883 - DNA, 1545 bp, Homo sapiens
ttctgcagctggatctccgtgtagggccccggagccggggacgaggtcaggttcccttgttaccgctgggtggaggtcgacggcgtcctgagcctgcctgaaggcaccagggcgagaagaggcgctcaccaaaagtcactggccaagccctcctctggccttctaggccgtactgtgggcgacgaccctcgaggcctgttccagaaacaccaggaagaggagctggaagagagaaggaagttgtaccggtggggaaacttgaaggatgggttaattctgaatgtggctggggcaaaactatgtgacctccctgtggatgagcaatttctggaagacaagagtgttgactttaaggtttcgctggccaaagggctggccgacctcactatcaaaaactaaatgttctgacgctgggcatggtggctcacgcctataatcccagcactttgggagactgaggcgggcagatcacgaggtcaagagatcgagaccatcctggccaatatggtgaaaccctgtctctactaaaaatacaaaaattagctgggcgtggtggcacgcgcctgtagtcccagttacttgggtggctaaggcacaagaattgcttgaacccaggaggtggaggttgcaatgagccaagattgcaccactgcactccagcctggtgacagagtgagactccatctcaaaaataaaataatgttccgacttgctagaatgatctgaatgacttcaaccagattttctgctgtggccagagcaagctggctggtcagtcccccaccccaatatgtctcccaggacgcttacccccagatcccacccaacccaggggaattgaaagaagcagggtggggagaccagagacttgggtccctctggtgggctggagtcaagggggcatggttggtggggttggaaggaccaagagctcagatcccacaacttgctcaacaactgccttccccagagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagcagcctttgacctcttcctgcacccagggaggcacattgttcgaagctgacttctccctgctggatgggatcaaggccaacgtcagtctctgtagccagcagcacctggctgcccctctggtcatgctgaaactgcagcctgatgggaaactcttgcccatggtcatccaggaggaggggagctcggatatgggtagtgaccgtcgggatggagaggaccggtggatgcgagtgcagagggagatgaaggagaggggaaaggggagccaggccaggtgcctgcagaaatagcaccaataaagagaacagggtgcccaggtagacttttgtctggccaatgttgagtgtcaaagtttttattacaatgttgcggcaagaaatgaggcttttgctaagtcaattcaacaagtgtct

SEQ ID NO: 461884 - DNA, 2051 bp, Homo sapiens
ttctggaacttgggttgcctgatagaccctatacaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcccgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgtcctgagctgaggcagaaggcctacatgttcatactgcacaactttgaggagatggtgaaagtctcggcagaatttttagagctctcggtcactgaacttaaggatatcattgagaaagatgagctcaatgtcaaacaggaagatgctgtatttgaggccattttaaagtggatttctcatgacccccaaaatagaaagcagcacatttcaattttgcttcctaaggttcgcctggccctaatgcatgctgagtacttcatgaacaatgttaagatgaatgactatgtcaaagacagtgaggaatgcaaaccagtcatcattaatgccctaaaggccatgtatgacctcaacatgaatggaccctctaattctgatttcaccaacccactcaccagaccacgcttgccctatgccatcctctttgcaattggtggctggagtggtgggagccccaccaatgccattgaggcatatgacgctcgggcagacagatgggtgaatgttacttgtgaggaagagagtccccgtgcctaccatggggcagcctatttgaaaggctatgtgtatatcattggggggtttgatagtgtagactatttcaatagtgttaagcgttttgacccagtcaagaaaacttggcatcaggtggccccgatgcactccagacgttgctatgtcagtgtgacagtcctcggcaattttatttatgccatgggaggatttgatggctacgtgcgtctaaacactgctgaacgttatgagccagagaccaatcaatggacactcatcgcccccatgcacgaacagaggagtgatgcaagcgccacaacactttatgggaaggtctacatatgtggtgggtttaatggaaacgagtgcctgttcacagcagaagtgtataacactgaaagtaatcagtggacagtcatagcacccatgagaagcaggaggagtggaataggcgtgattgcttatggagaacatgtatatgcggtaggtggctttgatggagctaatcgacttaggagtgccgaagcctacagccctgtggctaacacttggcgcacaatccccactatgtttaatcctcgtagcaattttggcatcgaggtggtggatgacctcttgtttgtggtgggtggctttaatggttttaccaccacctttaatgttgagtgctatgatgaaaagaccgatgagtggtatgatgctcatgacatgagtatataccgcagtgctctgagctgctgtgtagtaccagggctggccaatgttgaggaatatgcagctagacgggacaacttcccaggattagcactgcgagatgaagtaaaatattctgcttcgacaagtaccctacctgtatgagcctcttcatttagctaataaaaagtctaagcaataagaattaattctttttttaaaaaaatgcagtgtttaaactttgaagagta

SEQ ID NO: 461885 - DNA, 521 bp, Homo sapiens
taaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagtaaggctcacaaacctgggacataaaccatgaaatattcctaaaaccacaatttgagattgaccagtcaaaaatcaaatttagcaaggatcatggctgagatgtttatattaaatccatagctattgctggttaatatttttaatatttttatttgtgatagcctgtattttgatgaaaaacaatatattgtttcatatttcattattttgattgaaacctgttcattttactcttttgttaaaaatatatatttcgtatcttatttgtatgtgatcaaataaaatatggtgcagttggttggg

SEQ ID NO: 461886 - DNA, 1609 bp, Homo sapiens
gagtgcaggcgtctgcggcccccatggtgaccagaccgacttccgcccgacccgcccacctctaccggcccctaatcccgcgaggcgcaccatggcaaccagacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagccagctaaattttgtatttttagtagagacggagtttctccatgttggtcaggctggtctcgaactcctgacctcaggtgatccacccaacctcagcctccc

SEQ ID NO: 461887 - DNA, 611 bp, Homo sapiens
tgcgaggtgatctagaggatcccagttcgaggagactctcttggtaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagccagctaaattttgtatttttagtagagacggagtttctccatgttggtcaggctggtctcgaactcctgacctcaggtgatccacccaacctcagcctccc

SEQ ID NO: 461888 - DNA, 462 bp, Homo sapiens
atcctggtgcttgccctccctgctgctccctcttgtttcctgtgctccgatggcctgcatccaggtctctgatttttcttgcttcattgtgtgattgtacagatgtgtgcctcaatagagcagtgcctcacgaaaggctgggttttgtctttctaaaattttcctttcagggaacgctgtgaggagctccgtgttgaattgttatctatccatcagaagaaggtgtgtgaggagcggaaagcacagattgcatttaatgaggagctgagcaggcaaaagctgatggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggag

SEQ ID NO: 461889 - DNA, 1919 bp, Homo sapiens
gagtgcaggcgtctgcggcccccatggtgaccagaccgacttccgcccgacccgcccacctctaccggcccctaatcccgcgaggcgcaccatggcaaccagacttctgcgtcgcggaagcgggtcccgcaggtcgccacggttgggggaaacgcggcggacgccgcccccgtcccgaaggggactcgaaaatgtacagccagcggtttggcaccgtacagcgggaggttaagggccccacccccaaagtggtgatcgtgagatccaagcctcctaaaggccaaggagctgagcaccatctagaaagaatccgacgcagccatcagaagcataatgctattttggcttccattaagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaatgatctacttaatctcatgttattttcctgccccctttgcctccttttttaactcacttatgactagctccatttgctgacaactatctaccc

SEQ ID NO: 461890 - DNA, 3069 bp, Homo sapiens
gcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagcagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgagggaagcctggacagcactatgaaagggaaggaaacgcttcagggctttgtaactgacatcacagcaaagacagcagggaaagctctgtcactggtgattgtggatcaggagaaatgcttcaggtttggatttgccctggtgatttcatgttaaaaggggcagctcttgggccaaggggggtgagtttagtttattcattgcagatgtaggtcactctgcaaggtagtccatctctaacaagtccagggggatgctctggtccagtcttcttctgtatcttctgcctgacttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaatcagcccattgtctctcaagcttgaggcagaaggagctgacctcacactggggattcttgggaagagtcctcaagcctagcgccttttcaaatattctcctttcgcctatatgtaagtatgtgttctgcaggctgatatcataggccaggttaccataggccaagttaccaggattaattacaggtcagatcacaatgtaataagcactaggaaagcaaatttttggcctactcagttcaagaagtgttcactgtcagaatttaaaataagtaaatgacctcagagacaatccagtccaagtcccttattttatacttgaggggactgaggcctgaagagattgacttgtctaagctcctagcagttagaagaaccagaaatagattgcagattgccagatatccaaagaatctggtatcttttcttctactataatggactagatgtagtttttaaatgaatcagcaactggccctatacctggcaacaaagtgagcactcaaattgtcaaaggcacaaaaaggccagatgtaacatggcgcccacctcttccaaggtcagtgggggggttttcagttgccacttgaggggaacaggtgtagaagagtaatgagcaacttacagctctccaaccacgctgttgcaggaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggag

SEQ ID NO: 461891 - DNA, 2909 bp, Homo sapiens
  misc_feature (20)..(20): n is a, c, g, or t
  misc_feature (30)..(30): n is a, c, g, or t
tgcaggctgagtaccgcccncgggagttangggcatggcagcttgacagagtggcgggcatgaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacataagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcaggtttggatttgccctggtgatttcatgttaaaaggggcagctcttgggccaaggggggtgagtttagtttattcattgcagatgtaggtcactctgcaaggtagtccatctctaacaagtccagggggatgctctggtccagtcttcttctgtatcttctgcctgacttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaatcagcccattgtctctcaagcttgaggcagaaggagctgacctcacactggggattcttgggaagagtcctcaagcctagcgccttttcaaatattctcctttcgcctatatgtaagtatgtgttctgcaggctgatatcataggccaggttaccataggccaagttaccaggattaattacaggtcagatcacaatgtaataagcactaggaaagcaaatttttggcctactcagttcaagaagtgttcactgtcagaatttaaaataagtaaatgacctcagagacaatccagtccaagtcccttattttatacttgaggggactgaggcctgaagagattgacttgtctaagctcctagcagttagaagaaccagaaatagattgcagattgccagatatccaaagaatctggtatcttttcttctactataatggactagatgtagtttttaaatgaatcagcaactggccctatacctggcaacaaagtgagcactcaaattgtcaaaggcacaaaaaggccagatgtaacatggcgcccacctcttccaaggtcagtgggggggttttcagttgccacttgaggggaacaggtgtagaagagtaatgagcaacttacagctctccaaccacgctgttgcaggaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggag

SEQ ID NO: 461892 - DNA, 2211 bp, Homo sapiens
gcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagcagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggag

SEQ ID NO: 461893 - DNA, 3234 bp, Homo sapiens
ttaatggctgcaggaattctttttgagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagcagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccaggtcctcacatgtgtctttgtcctgtgctgagttatctgcgttctggaccccccactgacagtcccttttccatctgttgcagtgctcttacagatggaaggtgctcaatacctgctgacctccctccctgtgctgtgttctgggtactttggcaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggtaagaacgtcctgttgcctgaatcgggctgggtactcactggtcacctgagacttgctattgatagagaataaaatgcctgctgcgtactgttttctgccttggcactgactaagagaaggtaccaaacaggaagccaaggggctggggtgtggctttagtggacagtgacttggcagctagtctcttcctacccttccagtccatcgttgcttttgggtttctaggcattggtggatctgcagctacacacagaagcccaggctcaaattgtgcagagctggaaagagctggccgacttcacatgcgcattcacaaaggctgtggctgaggcgcccttcaatcagcccattgtctctcaagcttgaggcagaaggagctgacctcacactggggattcttgggaagagtcctcaagcctagcgccttttcaaatattctcctttcgcctatatgtaagtatgtgttctgcaggctgatatcataggccaggttaccataggccaagttaccaggattaattacaggtcagatcacaatgtaataagcactaggaaagcaaatttttggcctactcagttcaagaagtgttcactgtcagaatttaaaataagtaaatgacctcagagacaatccagtccaagtcccttattttatacttgaggggactgaggcctgaagagattgacttgtctaagctcctagcagttagaagaaccagaaatagattgcagattgccagatatccaaagaatctggtatcttttcttctactataatggactagatgtagtttttaaatgaatcagcaactggccctatacctggcaacaaagtgagcactcaaattgtcaaaggcacaaaaaggccagatgtaacatggcgcccacctcttccaaggtcagtgggggggttttcagttgccacttgaggggaacaggtgtagaagagtaatgagcaacttacagctctccaaccacgctgttgcaggaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggag

SEQ ID NO: 461894 - DNA, 2298 bp, Homo sapiens
gcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagcagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggag

SEQ ID NO: 461895 - DNA, 2666 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgttagcatttcatcatatcaatgtgaagattatttcttccagaccatggctggagaaggaaagaaggtgtgttttgcctgactcagtgactatagagagaaccaagttctgcaggcctgtcacctaagtctcagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctataattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagagaattcccattagaagtatattggccatcttaatggtatcccataagtcccttaggctctcttaatttttaaaattatttttaccctcctcaccatataatttcaaaagacttcttatgaagcttgctggattttttcctgctagatcaaaccagttgttggaccttctagtgaatctctaaattcagatttttaattgtgatattatgatgccgattttagaccttttctgctttctcttgtgggcatttagtgccataaatttccctttgcacactactttagctgtatcatattttaatttttaagccctcaatctttctttttcatcatgacagtcttgactgttttatgtttatgaaaactgtaaaattgtct

SEQ ID NO: 461896 - DNA, 2861 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgatttcttccagaccatggctggagaaggaaagaaggtgtgttttgcctgactcagtgactatagagagaaccaagttctgcaggcctgtcacctaagtctcagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctataattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacacacatgctctctttctttctctcacacccacatcctgggaacccaacaacttgatggcaggtagctctgggtatccttggtctggcattcacccactgggaatctaagctgtcctaaagctctgttcaatcacttctcactctttccaggcccatgtgggtaggtgttccagccttcactctttcagactgatcatagaggcacagtgtgggaaaatcccctactgtgatggccattgct

SEQ ID NO: 461897 - DNA, 2906 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgatttcttccagaccatggctggagaaggaaagaagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctataattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacgcctcagcagcagaggcgtttaggaagccagaggtcagggatttcaggggaaaagaaacaaggcctggtttattctctaattctttaaaaatgggataggagcaaaaggttaaaatatgtgggtctcacacaggaaaggccttctgaagaagaaaaatgggtgattcactggagttggcccagctacacgcctctg

SEQ ID NO: 461898 - DNA, 1522 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgatttcttccagaccatggctggagaaggaaagaaggtgtgttttgcctgactcagtgactatagagagaaccaagttctgcaggcctgtcacctaagtctcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacacacatgctctctttctttctctcacacccacatcctgggaacccaacaacttgatggcaggtagctctgggtatccttggtctggcattcacccactgggaatctaagctgtcctaaagctctgttcaatcacttctcactctttccaggcccatgtgggtaggtgttccagccttcactctttcagactgatcatagaggcacagtgtgggaaaatcccctactgtgatggccattgct

SEQ ID NO: 461899 - DNA, 2951 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgatttcttccagaccatggctggagaaggaaagaagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctataattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacacacatgctctctttctttctctcacacccacatcctgggaacccaacaacttgatggcaggtagctctgggtatccttggtctggcattcacccactgggaatctaagctgtcctaaagctctgttcaatcacttctcactctttccaggcccatgtgggtaggtgttccagccttcactctttcagactgatcatagaggcacagtgtgggaaaatcccctactgtgatggccattgct

SEQ ID NO: 461900 - DNA, 3050 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatgatttcttccagaccatggctggagaaggaaagaaggtgtgttttgcctgactcagtgactatagagagaaccaagttctgcaggcctgtcacctaagtctcaggtgagtatgaattctcttgtgtttttcacagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctataattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacacacatgctctctttctttctctcacacccacatcctgggaacccaacaacttgatggcaggtagctctgggtatccttggtctggcattcacccactgggaatctaagctgtcctaaagctctgttcaatcacttctcactctttccaggcccatgtgggtaggtgttccagccttcactctttcagactgatcatagaggcacagtgtgggaaaatcccctactgtgatggccattgct

SEQ ID NO: 461901 - DNA, 1343 bp, Homo sapiens
tatcccagcaggtgtagtgtgagaactggcatatgttaggctatggtgtcaaaagagaaataccccgttcatgagagtaatccagtgattttcaaaaagacaagacacactgacatccagcgcagtcagggcacaattaccttggaaaaatcacctcacacagaatggttgaggagactttctaaggagcctgtttgcctgtcaacccaaaacaatcctaagcaaaaacaacaaagcttgaggcatcctgctacccgacttcaaactatactacaaggctacaaaaaagaagaaggagaaggagaaggagaagaagaagaagaagaagaagaagaagaagaagaagaagaagaagaagaagaagaaggggacctttatgtggtcaacaaacacaaaaaagagaaaagctcatcatcactggagactagagaaatgcaaatcaaaaccacaatgggataccttctcacaccatgttgaatggcagttattaaaaagttaggaaacaacagatgctggagaggagggcgtggcttcctgcatttggcggggtctttgtctctcgctggcgctggcacaggaacttgggatccgtctcctctttcgcctcctgcaccttgggagccctgggctactctctcacagcccctgttgccctgtgatctgtaggtccttggggacgcatagtcaaggtgccaggacatcctggaagctgggaaatggtgagtatacggggttcgccatcccgagaggggagaacagactgtgaaaccggcaggaccgtcctccccacggttagctccgagtctcccgcagcttggccctcagtcccctgtggctgcaagatggccgctgggccagcagcgagggccccacgtcccgtccggcccatccggtcctgtccctgggcagcgccctgctctgcgcccacagccatgagtatttcccagattgttcagggaggcctggtgggtcatcagggaaaaaccgcgactgggtgtttgcgtgggaggagctgcggcccgtggggtccccagtctctcttgttaaaaattaacgggagtctatgttaaacgttaaccagtttatctgaacaaagagtgattggtgaaatggaaagcacccagccatgatttctggtccaccagaggggcataaaggaaaggctttcataagatgcatgagaaagcagcccaaattcacctggttacatattcagaggttaattgcatgtttgtcatgggttaaacctgcattttgcttcaggctaagatagtgttttataggaaatatatttgagttaggttttagatttttttttgtttgttttttgttttttacctatg

SEQ ID NO: 461902 - DNA, 427 bp, Homo sapiens
gtctcacctcgttacccaggctggagtgcagtggtgtgatcatatctcactgtacatctccaactcctgggctcaagaaattctcctgccatagcctcctgagtaggtaggactacaggcatgtgccaccacacccagtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaagaaagatttaaaaaataaacgagaaagaagggcctgggaattgtggctgctca

SEQ ID NO: 461903 - DNA, 375 bp, Homo sapiens
gtctcacctcgttacccaggctggagtgcagtggtgtgatcatatctcactgtacatctccaactcctgggctcaagaaattctcctgccatagcctcctgagtaggtaggactacaggcatgtgccaccacacccagtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaag

SEQ ID NO: 461904 - DNA, 343 bp, Homo sapiens
gtcgcgctcgtcggtgctccccgactcccagggacaagaagggctcctgatgggtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaagaaagatttaaaaaataaacgagaaagaagggcctgggaattgtggctgctca

SEQ ID NO: 461905 - DNA, 285 bp, Homo sapiens
  misc_feature (22)..(22): n is a, c, g, or t
  misc_feature (53)..(54): n is a, c, g, or t
  misc_feature (57)..(57): n is a, c, g, or t
  misc_feature (71)..(71): n is a, c, g, or t
  misc_feature (78)..(78): n is a, c, g, or t
tcgccaattacatcctcagcanataaagaaaaaaaaaaaaaaactaagaagannacntaccctcaagctgnacgcgcncaacttcgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaag

SEQ ID NO: 461906 - DNA, 1606 bp, Homo sapiens
ttatcgtcgtctcatgaaacagcaaaaaaacaacttaagggttggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggagttccatctcccgggctgatcctgctcctctgcgatacgttctgcagatggtcctgtgtggcccagtcttccaaatgcacctcttcagggatgcccatcctcagttagagaaacgggctgtaagtcagagaacttgaacttgacccagagcatggccagacacatcagctattccctacatcacgtttctttaaaataaagcctgccagcacaagaggcttgtagagtttgccatagtacatgtacccagggctctgcttttgttcacgattctgtattcatattgtgattttaatagctgctaatcaaagaaagaggctttctagtcattggtaagctggcaaagagcaaaacaaccaaatgcctgacaagcagctggtaaggaggttgtgctggagaaataaacatgcaattgtcttcccttccacaattcagaccgacttgcattctctttacctggcatcaacttaaagcgaaaacccctctgtgtctctccttattccacgcctttctcatgaaaagccaggaaaaagtttcccatccattcattcaacacatctccattgtgcaaggtattgtggaggatgtgtgggctgccaactctgagcccaaggtctatgaagttgaaactctgtctgaaaaagaagaagaagaaggaaaagaagaagaagaagaagaagaagaagaagaagaagaagaagaagaagaggaagaggaagaggaagaggaagaaggagaaggagaaggagaaggagaagaagaggaagaggaggaggaggaggaagaggaagaaggagaagaaggagaaggagaagaagaagaagaagaagaagaagaagaagaagaagaagaagaagaagaagaagcagaagcagcaacaacatgatcatgattagccactccgaggagtggacctccctacagcttctgcttacacatctgaatatgggtgtcctcccatctccttttaagaaatggatcaagcatggatcaggagtgcatggcatccttatgcactttgcttttctgtgctgtgggtgtctcagctggtcatatttagggggccagagatccaagggcccttcaacatttagccttcatcccctaaaacccccaaggtctgggaaactgagctcctgacaggtgctgcctgccaacggagcagttgcctgggctgttgggagggtcggaggcgggcttcctggtgtcagctaacctcagttctttctaagaggcaactttgccttctgaaagacaaatctatttccctgtcattttatctagagaagagtattctttgttacatcccataaattcctttttaaagttttcattatgaaggtttagat

SEQ ID NO: 461907 - DNA, 427 bp, Homo sapiens
gtctcacctcgttacccaggctggagtgcagtggtgtgatcatatctcactgtacatctccaactcctgggctcaagaaattctcctgccatagcctcctgagtaggtaggactacaggcatgtgccaccacacccagtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaagtggcggccgaaaccctccccctctctcaactttattgacgaactggtaacac

SEQ ID NO: 461908 - DNA, 441 bp, Homo sapiens
  misc_feature (61)..(61): n is a, c, g, or t
  misc_feature (72)..(72): n is a, c, g, or t
cgaacgcacagcactgtgcccggggcctgtcccccacagaagccagcagacgactttatgntaggacgttcnggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaagaaagatttaaaaaataaacgagaaagaagggcctgggaattgtggctgctca

SEQ ID NO: 461909 - DNA, 389 bp, Homo sapiens
  misc_feature (61)..(61): n is a, c, g, or t
  misc_feature (72)..(72): n is a, c, g, or t
cgaacgcacagcactgtgcccggggcctgtcccccacagaagccagcagacgactttatgntaggacgttcnggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaag

SEQ ID NO: 461910 - DNA, 413 bp, Homo sapiens
cccattttttaaatagtgaatgtgtttagaataaacagtcttgtggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaacgaataaataaaaaagaaagatttaaaaaataaacgagaaagaagggcctgggaattgtggctgctca

SEQ ID NO: 461911 - DNA, 1614 bp, Homo sapiens
cgttgcgctcccacacactccacggcacaaaaaaacattcgttagaggactggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggagttccatctcccgggctgatcctgctcctctgcgatacgttctgcagatggtcctgtgtggcccagtcttccaaatgcacctcttcagggatgcccatcctcagttagagaaacgggctgtaagtcagagaacttgaacttgacccagagcatggccagacacatcagctattccctacatcacgtttctttaaaataaagcctgccagcacaagaggcttgtagagtttgccatagtacatgtacccagggctctgcttttgttcacgattctgtattcatattgtgattttaatagctgctaatcaaagaaagaggctttctagtcattggtaagctggcaaagagcaaaacaaccaaatgcctgacaagcagctggtaaggaggttgtgctggagaaataaacatgcaattgtcttcccttccacaattcagaccgacttgcattctctttacctggcatcaacttaaagcgaaaacccctctgtgtctctccttattccacgcctttctcatgaaaagccaggaaaaagtttcccatccattcattcaacacatctccattgtgcaaggtattgtggaggatgtgtgggctgccaactctgagcccaaggtctatgaagttgaaactctgtctgaaaaagaagaagaagaaggaaaagaagaagaagaagaagaagaagaagaagaagaagaagaagaagaagaggaagaggaagaggaagaggaagaaggagaaggagaaggagaaggagaagaagaggaagaggaggaggaggaggaagaggaagaaggagaagaaggagaaggagaagaagaagaagaagaagaagaagaagaagaagaagaagaagaagaagaagaagcagaagcagcaacaacatgatcatgattagccactccgaggagtggacctccctacagcttctgcttacacatctgaatatgggtgtcctcccatctccttttaagaaatggatcaagcatggatcaggagtgcatggcatccttatgcactttgcttttctgtgctgtgggtgtctcagctggtcatatttagggggccagagatccaagggcccttcaacatttagccttcatcccctaaaacccccaaggtctgggaaactgagctcctgacaggtgctgcctgccaacggagcagttgcctgggctgttgggagggtcggaggcgggcttcctggtgtcagctaacctcagttctttctaagaggcaactttgccttctgaaagacaaatctatttccctgtcattttatctagagaagagtattctttgttacatcccataaattcctttttaaagttttcattatgaaggtttagat

SEQ ID NO: 461912 - DNA, 1606 bp, Homo sapiens
caccgacccgagccacccctccccccgcacaacaaaaactgatggggtttcgccatgttgtccaagctggtctcgaattcttgggctcaaaccatctgcccacactggcctcccaaggtgctgtagcatctcttcctcaaagatgagccagccgtcatttgaagaggaggaaaaactggattggggaagaatctggggcaaaatgaagccaaattgagaacgaggagaaaagaagatgctaaggccgcagataaggagttccatctcccgggctgatcctgctcctctgcgatacgttctgcagatggtcctgtgtggcccagtcttccaaatgcacctcttcagggatgcccatcctcagttagagaaacgggctgtaagtcagagaacttgaacttgacccagagcatggccagacacatcagctattccctacatcacgtttctttaaaataaagcctgccagcacaagaggcttgtagagtttgccatagtacatgtacccagggctctgcttttgttcacgattctgtattcatattgtgattttaatagctgctaatcaaagaaagaggctttctagtcattggtaagctggcaaagagcaaaacaaccaaatgcctgacaagcagctggtaaggaggttgtgctggagaaataaacatgcaattgtcttcccttccacaattcagaccgacttgcattctctttacctggcatcaacttaaagcgaaaacccctctgtgtctctccttattccacgcctttctcatgaaaagccaggaaaaagtttcccatccattcattcaacacatctccattgtgcaaggtattgtggaggatgtgtgggctgccaactctgagcccaaggtctatgaagttgaaactctgtctgaaaaagaagaagaagaaggaaaagaagaagaagaagaagaagaagaagaagaagaagaagaagaagaagaggaagaggaagaggaagaggaagaaggagaaggagaaggagaaggagaagaagaggaagaggaggaggaggaggaagaggaagaaggagaagaaggagaaggagaagaagaagaagaagaagaagaagaagaagaagaagaagaagaagaagaagaagcagaagcagcaacaacatgatcatgattagccactccgaggagtggacctccctacagcttctgcttacacatctgaatatgggtgtcctcccatctccttttaagaaatggatcaagcatggatcaggagtgcatggcatccttatgcactttgcttttctgtgctgtgggtgtctcagctggtcatatttagggggccagagatccaagggcccttcaacatttagccttcatcccctaaaacccccaaggtctgggaaactgagctcctgacaggtgctgcctgccaacggagcagttgcctgggctgttgggagggtcggaggcgggcttcctggtgtcagctaacctcagttctttctaagaggcaactttgccttctgaaagacaaatctatttccctgtcattttatctagagaagagtattctttgttacatcccataaattcctttttaaagttttcattatgaaggtttagat

SEQ ID NO: 461913 - DNA, 1522 bp, Homo sapiens
  misc_feature (6)..(6): n is a, c, g, or t
ggattngtatcccctctgctcccaggaatccagtaaaagtagcatctcttcctcaaagatgagccagccgtcatttgaagaggaggaaaaactggattggggaagaatctggggcaaaatgaagccaaattgagaacgaggagaaaagaagatgctaaggccgcagataaggagttccatctcccgggctgatcctgctcctctgcgatacgttctgcagatggtcctgtgtggcccagtcttccaaatgcacctcttcagggatgcccatcctcagttagagaaacgggctgtaagtcagagaacttgaacttgacccagagcatggccagacacatcagctattccctacatcacgtttctttaaaataaagcctgccagcacaagaggcttgtagagtttgccatagtacatgtacccagggctctgcttttgttcacgattctgtattcatattgtgattttaatagctgctaatcaaagaaagaggctttctagtcattggtaagctggcaaagagcaaaacaaccaaatgcctgacaagcagctggtaaggaggttgtgctggagaaataaacatgcaattgtcttcccttccacaattcagaccgacttgcattctctttacctggcatcaacttaaagcgaaaacccctctgtgtctctccttattccacgcctttctcatgaaaagccaggaaaaagtttcccatccattcattcaacacatctccattgtgcaaggtattgtggaggatgtgtgggctgccaactctgagcccaaggtctatgaagttgaaactctgtctgaaaaagaagaagaagaaggaaaagaagaagaagaagaagaagaagaagaagaagaagaagaagaagaagaggaagaggaagaggaagaggaagaaggagaaggagaaggagaaggagaagaagaggaagaggaggaggaggaggaagaggaagaaggagaagaaggagaaggagaagaagaagaagaagaagaagaagaagaagaagaagaagaagaagaagaagaagcagaagcagcaacaacatgatcatgattagccactccgaggagtggacctccctacagcttctgcttacacatctgaatatgggtgtcctcccatctccttttaagaaatggatcaagcatggatcaggagtgcatggcatccttatgcactttgcttttctgtgctgtgggtgtctcagctggtcatatttagggggccagagatccaagggcccttcaacatttagccttcatcccctaaaacccccaaggtctgggaaactgagctcctgacaggtgctgcctgccaacggagcagttgcctgggctgttgggagggtcggaggcgggcttcctggtgtcagctaacctcagttctttctaagaggcaactttgccttctgaaagacaaatctatttccctgtcattttatctagagaagagtattctttgttacatcccataaattcctttttaaagttttcattatgaaggtttagat

SEQ ID NO: 461914 - DNA, 1193 bp, Homo sapiens
actgccagcaggaggtttgacacattctctctggataactgaatggctcctgagaaaagacccccacattctgacatcttggagtcccgccccagtttaaaagccagtttgctgtccagcgaccttgttggagatgggagttttatctataagcccctgactggagctgctgcctttctttcagtgatgccctgcccagagaggaggaaactagagaggcagtctggctacagcggctttgttgcactgtggcgggctctgcccagtccaaacttcctggtggctttgtttacactggtttctctgaagtgttccgctccatcctggaagacagccttggctgaccagtttcaggagttcccagagatgccaggctcttttaaacaaccagcccagctctcacgtgacgtaatagaacaagaactcactaattaccaacgggaaggcaccaaaccattgaggagggatttgtcctcattacccaaacacttcccaccgggcctcaccttgaacgctggagatcaaattttaacatggtatttggtggggacaaaccctatcagcagctgcttttaatatttaaaaaaatattttgagagagggcccacagaccctctgaaagaagcagactgctcctgcaggacccgggggacaccccaaatactgtgagtgccccaactgcggaagtgggaaagggagaccctcctttccggaacacacaccccctactggagaagctgaaggtctgcttccgggagatgctcccgacttcacctggagctgagtcaagttagagaaccggaccaagcgaaatacaggggcagaggaggcagcagggaggccctgggagctctttgaatccccaggtagcctattcctgcctggcaccactgggattcatcaggagggaggccagaggagcaggaggtgggaggcggaaagcctcgggcaagttttcaagcccgtcctctgtctggaaacagactcagaggtgttgcaggggacacggtgggagtgagaccagcccttcggtgtgcgtgggatctgggggaggcctgtgactgccggctttcccctgcttctctgacaacctgcatgactcagcagaggcagccataatcctggagagccccggtttaagatctccaggtgaagtagatttttattttgattcaaagaactggtcttcaagc

SEQ ID NO: 461915 - DNA, 2422 bp, Homo sapiens
gcaggtgttttctgttctcagacagcctcgggcaatgaactctggcctgtatagttgcaaaaggacctcaactccatgtttatgctactccagaggaaaagagaagaagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggcaagtgtgccgctctggggagccacttttgcccagtgtgcttctggcattgtacacatggcatgtcacacgatcacaggtgtggagatcacctgggggctcgtcccaatgcaggttctgattctgtaggtctgaggggtcttgaggagagcctgccttcctaacgtgctcccagggcatgtcgctttggtgggtcagcccacctcactgagtagtgaggagagaggaccactctctgttctttcctaagtgaccacgacctctggccagagcattcgccataaagctagaggtagacgttatctgaaacaactggaaaaccgtttctccattttgtagactttttatgcaaatacctttgtggaaaccaaattttattaattcagcctaagtctcggacaaggatatacactcatgcttcgcttaacaaggaggaatgcattctgaggaatatgttgttaggcagtcgtgtcatgcaaacatcatagcacatacgtaacacaaacctacatggtacagccagccacacacacctaagctatatggtgtagccaattgctccgaggctgcaaacctgtacagcatgtgactactgaatgctagaggcagtcagtacacagtggtatttgtgtatctcaacatagaaaagatacagtaaaaatagggtatataagatttttttttaaatggtatacctatgtatgacactcctgtgaacagagcttgcgggactggaagtcagccatcttgtctgtttgcaatacagaccaacaggtctagac

SEQ ID NO: 461916 - DNA, 456 bp, Homo sapiens
ctcctaaagtgctgggattacaggcgtgagccaccacgcctggcatggattgttttatttcttaacctgggtggtgggtacatggctatatttagtttgtgataactcactgaactgtatccttacaatctgtacgttctatcaatgcaaaagtttattttaaaaaatattttttcgaagcacagtggctcatgcctgtaatctcaacactttgggaggccaaggcaggataatcgtttgagcccaggagttcaagaccagcctgagcaacatagcaagactccaatctctacaaaaaataaataattagccatgtgtggtggctcacacctgtgatcccagctacttgggaggctgagatgggaggattccttgagcctgggaggttgaggatgcattgagccatgatcacgccactgcactccagactgggcaaaagaacaagaccctgtctta

SEQ ID NO: 461917 - DNA, 433 bp, Homo sapiens
actttccatctcgctgtgtgcttcctcaccaggtgaattcggtgtgctgggcctcgctgaatcacttggattcccacattctgctatgcctcatgggactcgcagagactccaggctgtgccaccctgctcccagcatcactgttcgtcaatagtcacccagtggctcatgcctgtaatctcaacactttgggaggccaaggcaggataatcgtttgagcccaggagttcaagaccagcctgagcaacatagcaagactccaatctctacaaaaaataaataattagccatgtgtggtggctcacacctgtgatcccagctacttgggaggctgagatgggaggattccttgagcctgggaggttgaggatgcattgagccatgatcacgccactgcactccagactgggcaaaagaacaagaccctgtctta

SEQ ID NO: 461918 - DNA, 3843 bp, Homo sapiens
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaatg

SEQ ID NO: 461919 - DNA, 3864 bp, Homo sapiens
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaatg

SEQ ID NO: 461920 - DNA, 4433 bp, Homo sapiens
  misc_feature (3273)..(3273): n is a, c, g, or t
  misc_feature (3905)..(3905): n is a, c, g, or t
  misc_feature (4427)..(4427): n is a, c, g, or t
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcaggtacttgaggaaggaaggggaagttccaccccatcaaatactgtctctcaggggcgatcccagcaacttcagcagcagagggaaaagttaccccaaaacagaactgaatcaaggggagtgtggacagctgggtggggagactaggagggaagtagaattagattatattagtaatcaggagtgtaaataaatgtccaccaggtggacagcctcatcccatgtcagtgggcaaacgtcacttcagaaacaggcaggtggggaggtcctggggagcctgggtttggagtttgagtggatttcatcaggccagcattattccaccacgcaactatcttatccaaaaacttgggctccctgttgtctctactcacatttccaccagaggatgctgagaaaagaagttatggtcattgtaaagattcttggccccggcccggcgcggtggctcacgnccgtaatcccaacactttgggaggccaaggagggtggatcacgaggtcaggagattgagaccatcctggccaacatggtgaaaccccatctctactaaaatacaaaaattaactgggcatggtggcacctgcctgtaatctctcagctactcggaagtcagaagcaggagaattgcttggaccaggaagtcggaggttgcagtgagccgatatcacgccactgcactccagcctggcaacagagcgagactccgtctcaaaataaataaataaataaaaaagatttgtggcccctttactaccatccctgtggctccatgatctgcagattaggagcagctatctggccactaagccccctggaagggagttaccagttgattacagatgatggtggctatagcgtaatcagacagtgtgcaggctcaatgctttcacactgaaatagtagctgctgacactgcagaatgtgttctcagtcttcaagaattgtcacctctactggtattcctatagaaagggcttataccccatggaacatttttgtggctaggaagcattactttgttaggacattcatagacttatttactattctcatcaacaccaggacttcgcctcctttttaagtngatttttcacctgtttttatcacagaagagctcttgtgagctggatgatagagagagctcagccttgctgagaggcagatgcaggtagttaccagctgcagtaataaactgcagccgggattcagcttcagccaagatagcacttctggtcttagagccacacaagtgatcagaatcacaaatgtgaaatccatgactgcccaaggcctgtcctcttctcctgctgaaggtctccagtagtgtatatcatgtttctgggctgctgtaacccatgctgttgtgtgtcacagtcctcagaactggagccctgaagacttaaaccggtcctaggaactgaagcattaaaccagaaagagctgtggggagagttgtcaacctagcccatccccaggatgtaatgactttgacagatcttttactataacatgaaaagatcaggccaggtgtggtagctataattccagcacttagggagcttgaggccaggagtttaagaccagctggggcaacacagcaagaccntatctc

SEQ ID NO: 461921 - DNA, 3351 bp, Homo sapiens
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaaggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaatg

SEQ ID NO: 461922 - DNA, 432 bp, Homo sapiens
cccacgagctgcgtctcagctgcatggagaggaaaaaggtccagattcgaagcatggatccctccgccttggcaagcgaccgatttaacctcatactggtgagtgggagggggacacctgcctagggtgtggctgccaccctctggacactttgtggcttagcgttgccagtcatcaaacctggctctggagaagccaactgcaatgaaagtaggtggcatcttcttggttgtacgattttaacctgcctgctggctacccgctgggagacgctgagctggcaggcaggctgtggggcgaccatcatcaccccccacttcagctccgtcgtttaacgtcagagtctggacccagccacaccttgactactgaactttacacaataacttctccttggctgtgttgtatatgcaattaaaaaggctcacagtg

SEQ ID NO: 461923 - DNA, 327 bp, Homo sapiens
acatggggtctggttcttctagccactaacaaggaatcatcctcccttccaactccattgagacccaaaccctgaccagcacgtgtctaatcacaccgtctgacccagaggctggaagaggggttgtatcaggaggacctgccctgcccagcctcagagggatgtcatgatagccaggcactgagcagtccctctttccacaggctcctctgctgtttaatggctgccgctctggggaaatctttgccattgatctgcgttgtggaaatcaaggcaagggatggaaggccacccgcctgtttcatgattcagcagtgacctctgtgc

SEQ ID NO: 461924 - DNA, 478 bp, Homo sapiens
cccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaa

SEQ ID NO: 461925 - DNA, 1182 bp, Homo sapiens
gggccttcacatgcatgtggtggagacagaatgggaactcaggcagtctgactccaaggccggctcactctgccactgtggcgtgtgacgggaggctctgggttcactacacagacccagtattcctgccggagggctggtgtggtagcagaggaacgaggcggaaaggagcagcacagccttggggaggaagcccagctcctcctgaggccagggaggaaaacagtggtcaggagagcagggtcctcctaggggaagctgagggcaaggtcagagagggggttcctttggcagtggacatgggtctgtgggctctgggcctcaggtccctgctggcaacagctttttagagcactcatcacactagtctctgccttcccggagagcaagcagagccactttgctgagagcacggtagtacagtgtcgtggtccctggcctctgggacccttgggggctgttgatatggcacaagacttgactcacccaaaaccacatgttaatgactcttgtccttggttcattctcttattaaatgtgttctggaaacaatgtgactactcattgtacctcacacctacttcctgagttgtggtgagattaacattagttaactcctgtgaaggcacctagcagtttctggacatcattggtcctcgacaaatgataactgaatcaggatcttttttgtaaattttatttgtttcacagcactgtatttcaaaggagttttttttgattttaatttttttcagagaaaggggtcttgccctgtcacccaggctggagtgcagtggtacaatcatagctcactccagcctagaactcctgggctcaagtgatcctcctgccttagcctcccaagtcactgggactgtaggtatgcaccaccacacccagcttacacttcaaagggtcatagagcctaaatacattagcgacctgattataaatttatataaggcatcaaactatgtgtgttctctaaattgcaaattttatgtggctttcatttgatggggttctgtaggccaatgggactgaccacatgttactatgatgatctaaccagagagctaaagaggccaagctctgcagaaagcaaaaacaagaacctcactcacatttccagtcttaaaacagcatggtattctcgtttctgtgggctaaggagaggaaaaa

SEQ ID NO: 461926 - DNA, 3867 bp, Homo sapiens
gcaggtgttttctgttctcagacagcctcgggcaatgaactctggcctgtatagttgcaaaaggacctcaactccatgtttatgctactccagaggaaaagagaagaagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaatg

SEQ ID NO: 461927 - DNA, 3764 bp, Homo sapiens
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaaaaaaaatg

SEQ ID NO: 461928 - DNA, 2938 bp, Homo sapiens
aattgactgtggtgatggctgcacatatctctggatatactaaacactattgaactgtgtactttgtttgtttgtttgtttttagagacagtatctcactatgttgcccaggctggactcctgggctaaaggatcctcccacctcaagtgaccacagcaggagagatggatggaagccatggaaccagctttgtacactataatgcccagctttgtacactataagtgggtaaattttatggtatatgaattatatctcaattaagctatttttaaaaattctctactcataataaataccagaaatttctgtggctattttctcctttagaactgtgttaaacaggtagaaaatggagactattagaagagattcaattttcaatttggtgcttctatatttatatgaagcctgaaggctgaggtgggaggattgcctaagtccagaggtcaaggctgcagtgagccatgattacaccactgtactccagcctgagctacaaagcaagacagaaaaaaaaaaaaaaatcttgtatattagctactctggagtgactcctcaaatgaagtctcacaatgcgggctgaactgagaacctgttttacttaatgaccaaagctactcctacctcaaatttgggtttcttttaagttctgagatatagtgcgggtaggagggacaattccatctgaattgaggtcctttttcagttttataatgtctttagctagttttgatcatgaattatgaattttggataaactttcatgtgacaaaaccaaggaacaaaaacaaggaatatgactggaagcactgatgacaatatcaaatagtataaaagtctaaggaaggagggtggtagtggagaaagagaaatccaaaaaccctagaactgaatcccagcttgactacttccaaggtacacaacctctggcaggtgacttgaccatgaacctcagtgtactcatctgtaaaatggggctattcataccagcttctgcatgtgatactaagaaatcaaggcacagagaagggaagagactcgccctaggtcccacagcaagcagcagtactggagccaacacggaggccccccggtttcacggtcagggctcgctacgctacaccctgaacgcagacccagggcagcggcctcggccgcctgaggccactgccgaagacttcgccgccaactccttcgctctttccactacagcgagaggacttctccagggccgcatcaccctgcggagggaggaagacacggtctctcacgaaagggtctccagacagttccgctgctccgggagcagcccccggccccgcccccgcacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctatgttaatgactcttgtccttggttcattctcttattaaatgtgttctggaaacaatgtgactactcattgtacctcacacctacttcctgagttgtggtgagattaacattagttaactcctgtgaaggcacctagcagtttctggacatcattggtcctcgacaaatgataactgaatcaggatcttttttgtaaattttatttgtttcacagcactgtatttcaaaggagttttttttgattttaatttttttcagagaaaggggtcttgccctgtcacccaggctggagtgcagtggtacaatcatagctcactccagcctagaactcctgggctcaagtgatcctcctgccttagcctcccaagtcactgggactgtaggtatgcaccaccacacccagcttacacttcaaagggtcatagagcctaaatacattagcgacctgattataaatttatataaggcatcaaactatgtgtgttctctaaattgcaaattttatgtggctttcatttgatggggttctgtaggccaatgggactgaccacatgttactatgatgatctaaccagagagctaaagaggccaagctctgcagaaagcaaaaacaagaacctcactcacatttccagtcttaaaacagcatggtattctcgtttctgtgggctaaggagaggaaaaa

SEQ ID NO: 461929 - DNA, 791 bp, Homo sapiens
actgaggcaactgcctggccagtgtggaggcagctttagtccctgggaccgtttctgtgcccaaggagagggagggcaggggaaggatggaatttcatctagagtagcaggtcctggttgcctggtaaattatgcatcaggactgggctagccactgcctccgttttctctgggctcctgagataacctccacctgcctctagattctgtgccagctgatcgttatctatctcatcaactcttgttccatcaggaaactgcatcttggtggatgatgaaccaataaacctggacacaatctcccgaataacaccacacatgccaacaaatgacatcagcattccagaatgtaagcggctggaatctgatgaagataagaactaacgaaaatcccacatgagtcatgctaatatacacaaagagggctcaaattccaagaatcaatttccagatcagtaagccaagatcagagcatggtaaacacctatcataaatgaaatggtagaatcctgacatggtgtttaatgatggctttacaaagtatcacatttcatagctgtgaactatccccaaatcatctcacaaaaaaggaaagatcaaagaaaagggcaattcagaaaagatcttatttctctctctctcttgcatgaaaaagagcacataaaatagaagcagtggttaccccagcgtggcccttcagagaaccgaggtaactatggtaactaagaacggtcttttagttcgcaaggttcgaattctagaactgttggttggatttggggtaagtccca

SEQ ID NO: 461930 - DNA, 686 bp, Homo sapiens
actgaggcaactgcctggccagtgtggaggcagctttagtccctgggaccgtttctgtgcccaaggagagggagggcaggggaaggatggaatttcatctagagtagcaggtcctggttgcctggtaaattatgcatcaggactgggctagccactgcctccgttttctctgggctcctgagataacctccacctgcctctagattctgtgccagctgatcgttatctatctcatcaactcttgttccatcaggaaactgcatcttggattctgggtcaacatcatccccacggtggatccattggtgagagcaataatgaagcaggtttgccaccaggctcccaaagaagtgggaacactgactgcaaagggcacaatctgattggatgaaaagcgaggcctcagaagcattggcacgtgtccgcgaagagcctagctggagagacccagacacatgcaaatggccttctgagttcattcttgatggagaggagctggaagaatccactaaggacaaattgccctgtggatttagtaagagatctgtatatagtggagccccctgaggctggcttgttaaagtagtatcttctgcttccctgacagcaaattcgtgtgcactgtttactgggaaataattatggttttcggcactggcaaatggagtcctatttctaatgggaga

SEQ ID NO: 461931 - DNA, 584 bp, Homo sapiens
tttctttataaatacgtatattttaagagcaacaaaacagagacaattttctcaaaataagcaaccactaaaatgtcaaggaaggacccatttatgacttaaaattcccatggctctctaacgaaagcaatgctaattttggccttgggaaagtggaaaaaatatataattatgaaaagtcctcacctttcttgcaatttcttgagtttctcagggtctgcctttatcttactggtttccttttcatctgtgaaaccagaggctgccatcctgctcccattatcattttgatttgggaaatgagacactgcaaagaaagtaaatggtgtattttcttgcagagacccagacacatgcaaatggccttctgagttcattcttgatggagaggagctggaagaatccactaaggacaaattgccctgtggatttagtaagagatctgtatatagtggagccccctgaggctggcttgttaaagtagtatcttctgcttccctgacagcaaattcgtgtgcactgtttactgggaaataattatggttttcggcactggcaaatggagtcctatttctaatgggaga

SEQ ID NO: 461932 - DNA, 1877 bp, Homo sapiens
actgaggcaactgcctggccagtgtggaggcagctttagtccctgggaccgtttctgtgcccaaggagagggagggcaggggaaggatggaatttcatctagagtagcaggtcctggttgcctggtaaattatgcatcaggactgggctagccactgcctccgttttctctgggctcctgagataacctccacctgcctctagattctgtgccagctgatcgttatctatctcatcaactcttgttccatcaggaaactgcatcttggattctgggtcaacatcatccccacggtggatccattggtgagagcaataatgaagcaggtttgccaccaggctcccaaagaagtgggaacactgactgcaaagggcacaatctgattggatgaaaagcgaggcctcagaagcattggcacgtgtccgcgaagagcctagctggaggtctgtcctagaggaggggctgaaggaggggcgagaatggcagcgctccatttcatccgactgctctgtgttcctcacatctgacccaaccttccgttacaacacaggcacatttgtggatactcttggttacatgtgtgttctctccttagattctgagtctcttctaggaaaggagtgtcttaatcatctttgtattcccagaagctagtttagaggctagtatgtagtaggttcgcagaaaatctttgaatagcggctgaggtgggaagatttcttgagactaggaattcaagaccagcctgggtaaactagcaagacccccatctctacaaaaaataaaaaattagccaggtgtagtggtggatgcatcccagctcctcaggaggctgaggtgggaggatcacttgagcccaggcattcaaagctgcaatgagctgtcatcccgccagtgcactccagcctgggcaacagagtgagaccctgtctcaaaaagagaaagaaaatctttgagtaaataaatatatgttgaacttggaagtattcctttacctagaatattgttctctgcaaattttgtactatcactttctccaaaacataactcaggactcgcctcctggaaaaagtaggttcttttttttttttttctttttgagacagagtcttgctctgttgcccaggctggagcgcagtggcgcgtctcggctcactgcaagctctgcctcccgggttcacgccattctcctgcctcagcctccccagcagctggggctacagggctgccaccggacagctctgggtcacagccagacttaccctctctctttccacctggttgtggttgagcctcatgagttctgcaaacctctgctcatagaggtgaagcagcagcaccagctcctcctcaccaacaaagccttggtccttatttgtttacctcatccccggcttcctcctgcaaaagctgccagtggttctctcaccagtgctctttgccagccagcttttatgcttgagacaccgggatgcatgatgacaaatcaatcagctagaaaatggtttggaactatcagaaaggccttctctggttcagagagcaagtcggagtcccacagctgttcccgcagcggcctgcatggtccttgttttgacctccacctgcaggaattgctggcttcagtcttcgctgctggtcggtagggccctgcgggtcttggaagggttgttgattttgcactttttaaagctttttacttgttgttaaaacgaagtgacaacttcaaactctttacatactgaactggaaagtgtactaagtctttgaaacttggtgtttaaaattaggtgatatattacccccctttttttttttggtactgtgtctttgaaatttggtgtgtatgtgacacttacaggatatgttgattagaa

SEQ ID NO: 461933 - DNA, 5579 bp, Homo sapiens
gtttcccctcccagagcgccggcgtggcgagatccaggctgggctggagctgggtcctggacttggaaaggcctgtccctggatagaggaacaggagataaagcaggggcagggctgccacgggcagggggcctgggtgtcctcgggcacgtagtgcggcccttctagtggcggggagggtgggaggactctggagccagccacatggagacagcacccacgggttggggacttggctggcggggacttgcccaggtaactgttattgctacttgtagccaccagatggcaccagcgcatcatgtgtccccggtccttgctgggggtcccccccccacccgccaagatgattaacctttcacaacacccacaccctgtccaacgccttcccaggactttacacccagaggaaaacatgcagcaaaataccagcagggccagggtaggggcaggagcatccagctccctggggagagcctctacctgccattcccttcagggtgtccgcccacgcccaccgagggtgtgatagcctttactcccggcaagccagtgaggtcctagtgatcatctccagagaacagaattcagagaagtgaagccacttgctgaaggcaggacagcacgtgtgtagcggaagggaactcaaacccaagcttcgcaggttccaaaaccctgggcttcctgggcaagtgaggcaggaaggggctggggcaaggatctccagagccagagcgctctctcccacaccaagtccctgttcctacttccgtccctctcatgtctccttggtccgcttctttcagacctgactcagaaccctctgcccagggaggtgctcgggccaatcgaatgggggagacagaggtgcggccatctgggagcccctgctagtgttgagcctgagctaggggaggggaccgcgttggccctaacttgggctaagctcccctctggcccatcccgccgccccacccctcactccctgtcccgctgggaggctggctgtgggctggggccaggagggccagggtggggtcccttcctcaaggctggagcaggatcctcagcaggctgtggcagtgcccaggagccagagaggagccgccgccccccacccccttgggcccctctgtaattagggctatttttaggcccctcttccttcctatttcaggcctctggactgggccggagagtgggctgtcctggggccgcgggctggagccgctaaactgggccgcggcactgcaggcttctacctgccccaggcgggaggcaggggagagaaagaggagcctgcccgcctgcccgccgcccctctgtcgtctccacgctcagacaaagagctcaccctggtctctgtgggcgtctgggagacgctggggggattagctgcccgcaccgccctctccccaccttgtgccagcccacccggctggcaccaacacctcaagcccaggggcggtgccctcaccgcagcctctctagcctgggagagtgtgtgtgtgtgtgtgtgtgtgtgtgtgtgtgtgtgtgtgtgtgtcttgctcagcaggggagccctcatgcattgagaacatgctggatgccaggtgccttacatacatcgtcacatttaattctcacaacatcccttcaagaagtccctgaggtcagcagcctgcccttcgcctggggatgctgcccgtgagcaggtggctctgacctctggccagctgtgggcaggggtggaggaggactggggggctgagactgtgtggtccaggtggcccgagcagagggtggcccctcctgtgtctctcctctccctctggcctcgcctcctggccctttgatgctcctctcaccacagacttcaaacaggctgccctctgctctgcccgccgcccgccctgcctgcctgcgataattagagcctcactccctgcctcttgccctcactctcttcccagctctccagggaagctctgccagctctctaggcgccgatcctccattcttttttcattttctcaccccttctctttttctccatctcttccctctgttcttggttctctgtctctgatcctctgagatcttcacccccacacatggttggctgccctcttctgtgcctttaccctcccagaaactgggcctcgggactcccctctgctccctgattgagctgggtcctggtgcaggcaggaagccctttgcaggtctggattttctgactcacctggcctcccacccagagtgcccccttcgtggccctgtgggaggcggtaccatggccattctctttcccaggagaagaggggtcttgcctaggagcctctccgtggcctgatggaaataggggagccaagaaccccacaaacctccctccacagagcactggagcttgggctggaccttgagcccctgccagggcccaggcacctctggcagtatctgtcagtcaggagcaggggtcccatggccactgaggagaggcttataccgccccccacccccgggcccaggacttctggtgctgcagatccaggcctcttggagagactagtttaaaggggcaagggccttggagggtggtgagagcccaggctgtgcacagactcccagggctgagagccagatgggtgggagcccccactggcactgcagccccggactggacccttggcatccctgggctgcagtttcccaagggcactgtgatggctgggcagggggaggggtatatctgaggtcgctggccctccacgagtgacttcccaagaagttctggacctggggaatcctaacctggggcgaggccgggacctagccctctcctggcacctccccccatcctgcccccgtcctggggtccccggctatggcagcccaggcctagacaccactttgagacgggagctccctgccgatggaagacccagtctccgcctctcttggcctctcctttgcccaccccgcccccggaatgctgccgaggacccagcccggtaggacagggcagcgggacttgtctccgattctacggcctcctctccgcggagggacccggacggggcagctgcagttcccgcgcaggcctctgggtgctgctcggcagctgcggtcgctcaccgccccaggcggccctatacctgacaggtcctcacccgggccttacggctccctcccgctccccgcaaaggggccaccttcatttactaaaagggaaacagccactcaaagggccgaagtgatcctacttggcgttagtattgctgaatcccatttacacacggggacactggagctccgaggccaagcggattgtctaggtctcacagaaacggggggtggtggggatcctggcaaaaaccttagaaagacccctctaagcccctcccttctatatcagttagatttccagaagaacttcccattcataggtgtgccaggaaaatcttcagcaggtgagaaaagaaaaagcaattcagggacatttggggcagttcagggcaaggtgggtgagcgcccctcattccccttccatgcccagtgtcatggactctgcccctccctgtcctgggcctcttcgaggaagaaaggggaggaggagcctctgtcttggcagcccttgggagggaatggaggaggggagcccgacagaggggctcctctgcagggggccacatcatgaaggagggcttcttcctccccctcccttctcccctccctcatcatctgccccgccttgccccatgcccagcattctcccagcagggtctggggggacagcagcaattttgacggtgggcctaagagtatacaatatgaggctctgggacctttcagatccacctgacttggccaggccaccccttcttccctttgtggtagtgatggggggtcttcaggatacacagaaccactgccctctgctccttcccactgttctgggagctctctcctctgcgaggctttcctggaacctgattggcgaagaccgtttctcctgagctcttttctctgagacatcaccatagatggctatgagtcaagtgcccccatcaaccattcctgctctgcctgggggcttggagtcccttctgatggacgaatgggtattgactcaactggctttgtatgctgggcaccactttgcaaacagcttacaggatggactgcagtcctcacaacgatcttcaaagcacgctcggagttgtggccctacggggacccggtgaattcagctgcctgtatgaggtgatgttgttttgccttaaatggtcccctagcctctcccaaagacccctccttactcttcccaagaatgtcccaattcctttcccacttgtgccactcattttcaagagaggagatggcccagccctcttctcttccccacctccctcccccaaactgtgtgaccctcagcacccagggctcagggggctgccagagatggagaggaggcaaacccaagccagctcctggggtcctacagggagggagggcatgtaaatcttgcctcaccctcttccctcccagccctgctgtcagctggccagccccatccctggagccaaactgcttccatgcaggagggagggaagcctgctcagtgggaaaagatgaagctggtccccccgcgtgtcagtgaacaaattgggccaatttggtgtgattagtgaagaattcacatctggccagcagagtcctccccccagccccagcccagcctggctcctgctccccattagaagctattttctctgacggctccatttgtctctgtagtgggggatttgacagctccctggccagcctgggaggcctggctctgagtgagaggcccaaggccaggctgtgtgcccacacccttgacctgatgccacgggggatgccatgctccaaacagggcccaggcacctgtatgggccctgtaggtcccatccctcttctgtgtgcacagatccatagttgaatgggggcctggggagcacagttcactaggctccctgacctgggccccccttgggccttggtcatcttgcacaatgattattgtgttttaagatcaacagagacttgtatgtgtgtgcatggtggtagaggaagcaggggtctggtgtttcctaaaagaaaacagctgggcatgtaataggcgggcctgcaccccacttccttcaccccttcctcacccctcccagagacctgttgctgcagctacccctcaggaatgcctgtagatggctgtcgcacagctggaaggctcgccccgagaagcggcttcaagcagcaactggcctccaggagacggaacccgaagaagtcaagatttttaaatgtctgaaaggacttttggaggaaaaggggaccagcatcagatctctgctcctgctgtcctgggagcctggagctgctggggctggttccccatctgtcctgccctcactctacctctcctccaaaggccccttccctacctcagcctctcccttccccttctctgcccatgtacccagaggctggaggccgggtgcagtggctcacgcctgtaatcccagaactttgggaggccgaggcaggtggat

SEQ ID NO: 461934 - DNA, 1743 bp, Homo sapiens
atctgagagtcggctatgcagcagccatttcagatccgagagtcagccatgcagcagccatttcagatccgagagtcggccatgcactagccatttcggatctgagagagtcgggcatgcagcagccattttggatctgagagagtcggccatgcagcagccattttggatctgagagagtcggccatgcagcagccattttggatctgagagagtcggccatgcagcagccattttggatctgagagtcagccatgcagctgccattttggatctgagagagtcggccatgcagcagccatttcggatccgagagtcggccatgcagcagccattttggatctgagagagtcggccatgcagcagccattttggatctgagagtcagccatgcagctgccattttggatctgagagagttggccatgcagcagcgtttcggatccgagagctggccatgcagcagccattaaggatccaagagtcggtcatgtagcagccatttcggatctgagagagtcggccatgcagcagccgtttgggatctgagagtcggccatgcagcagccgtttgggatctgagagagtcggccatgcagcagccatttgtgcatgcttcccttctcccagccccacaggagactgactctgcatcctgcctcctttcaaatgcatcctgtgccaacagtttctgaaaacggataaacaaattgacaacctcaaatgcaaagatgaaacatttctccagatcatcaggcacatggtttactcaggcccagaggagtgagctgatataaagaagctgtgccacacagtcggatggggtccgaaggaaacaatagggctgagtgatgagtattgaagaagaaatctaaagaaagaatgtcttatcagctgaccgcaaagctgcctccttctacctggccacattgcttatctattgtactgcgtctctcttggatggaaacgatacaccaatcactcataagtgaataatttccttctaaatcacaggcctacacctgaggtggctgccacagggaactgcacctgtgtcatgagagagacggatgagcgctgcccagcagctgacaggcaacacgccttgtccctcccttgggaacaggtcctgcctttccctgtgggtgtggcccacagagcagcggggttctctcccacagcagcagactcagtgtgggcagagtaagtgcttggatgctgcagaggcgctccaggcacctgcaatgaaggcagagctatgggaatcaaagcagggcccctgcatgagggcatgcaggaagtccagggcttgggatgaggatcaatttctcatctactttgcagatgtccttagtgaggtccccatgctccacattcctgttctgggaaccatcaagagggacagctcatggaactggatcctggcaggtactgtgtggaatggcagcagggaagtgcatccccaaaagctcccacgtgaatcaggagccggcagagggtggggcgggaatctcaggggctgcaagctaggagatgctccgtgctccgtgtcctcccacttttcccatgtgcccttttcccatctgtgcttgagctttaatacgtagagggaaacaaacggtgaaaggcatcagggaagtttgtgttcaaaccaaccagtatgagagagacaggagagagagagagagaggtttctttttgactgacagaaattcactttcaaagtcttttaatatacagatt

SEQ ID NO: 461935 - DNA, 2419 bp, Homo sapiens
ctggctacatgctctccccgtgatggggccggagctgggctggggacacccccgcggcggcgacgtctgctcctctgattccttcaacgaggacaacactgccttcgccaagcaggttcgctctgagaggcccttcttctcctccaacccagaactggacaatctgatgatccaggcaatccaagtgctgcggttccacctgctagagctggagaagggaaagatgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggagaaaataaatcataaaacttgttttacattcaaaattactttcccgagcatgtcttagagtaatctacgtgttgatgtatgtaaattgtattttaggtaggcaaagaaacaagtctggttatttatgtaaaaactagtctaataaaactcaataaacagaattcagacagatgtaagtcaaaacaaaactttacaaagccaagtgtattatcttttgcattaacctattttttccatcatacatgctactagtatgtgcattagcatgatattctcatatacattgcattaaaaattaaaaggtagcagctcagggtgagctcttctgtcattcatttgttcctaaatttttaagggctttttctcagtcaatatttgtataaactgggtagtttaacttcattacccatttcattaaagttgatggattgtgatgagatgcatttaaggccaatagtgacagatttttttttaatctcttgaacacaagctttgaatgataactacaggttttaagtgctgttaacattaataccataatgtgatgtgttagaaccaaagggatattttaaaggtagatatctgaaaattctctagtctcaatgtatatatgtattgaatatactctaaaaataaatgtgcaatttgctagtaggacaatgcagtgattagcattaggtatgtttcttcttttatatcctagctatgtcccactttcttctaagtgcaatcctttcatgttcacttgttgttttaccccatctactctaacttcagttggaagccttgtctagagtatagtatgtgtttttacctttgcagtgaattgcatgtgctaattgtaaccacagctatttttatgttgacataactccaagtgttatattaaatgttctattttatattagctctaatcccttaagtaaattttaagaaataaattcttgttcaaaaaaaaaaaaaaaaaaagaagtgcttccttgtcctaaggtcatgacaactttcatgatatatatatatatatatatatatcaaccactgaatttagtgtaaggtactgaaaataaagaagaaatacttatttaagggcctgccttgc

SEQ ID NO: 461936 - DNA, 2608 bp, Homo sapiens
gtggactcttggggatttgcaggctgcattaagtacaagtctggtccagttttgggtgcacgtattccactgaatttggtggcatttttcaactccgctggagccagtgcccaggaggaacaaagtcccagaagaagccagaggtagcggccccagccccagagagtgggggtgagtctgtgtttggggagacccaccgggccctgcagggggccatggagaagctgcaggacagacagacaccatagtgagcgagaggctagggcaccgctggggggagctgccaggccatccgaggggccccagcatctgagccatgtcctcctgcaggaaagtacatcagccagggggcagtgtcagagacgcagcactgggagaggaggacatcgtcaggctggcccaggaccaggaggagatgaaggtgaacctgcaggagctgcggggcaggtgttgcagcttgtgggcgaccacaaggaggggcatggcaaattttgaccattgcccagaaccctgctgatgagcccactctaggagccccagtagcccaggagcttgggtgtgctgacgagcagggtggcttttatcctagatcaccactggattgctgacagatagaggaggtgggaccctgactatcacccctaatctgcagtggatttggctctcggcactcccaggctgggagctggatacctgccctggcagcatggctcagactgcatgacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctggcggacccagcaggaggaagcccaggagctgggtcctgccgcccaggagctgggccctgccacccaggccgggctagggacatggcagggcctgggcatcctggcgctggacttgggcgacctgggaggcacagggaggggagagatgggcggccccgccccagcgcagtgccggccacacccatgcaccgaagctcctccctgccacaccccaaggcggttgccggagcttaagccccgcccccagcagcgagaacatcccacccccccccccctgcagccagtgctccttgtcaagctccccccgtcactccaggtgggagccaccccggtgagggggtgtgccacttgtccccagggcactcctctgggcatcccgggtgggggattttggggccgtggggggcagtctctggtacctgtgtgcgtcagggatgctctgcacctgcaaccaggtgtcgtccacgggcgggggcatggtaacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacctatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatacctggatacaggagctctgtgggtgggagtgaggcaaaacacagggtcctgaggtctggggaccaagcaatgtcctctggtgaaaaaaatcctggacttgctggcagaagttttgcctcttacttgccatgtgctctgaatacatttacctgccctct

SEQ ID NO: 461937 - DNA, 2378 bp, Homo sapiens
gattgaatctacccggatttctgggtgctcggggcgcgcggggtgttgctgctgctggacgccctccccgcacctccgccccaggcgcggggcctgccccaaccctcgcgcggcccctcccccgttccccctccccgccgagcgggcctgagccgcggagcagctacgcgagtgcggaactcggggcgcgggcggcggtggggcccgggcgcgggcagggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctgtgccaggactaccagggcggcacgctggccggggacctctgcgaggacctgtgtgtggcgggaaagctgctgttccaacgctgcctgcactacaacagaggcaagaaggtgctgcaggccgactggcgcggccggcccgtggtcctcaagtccaaggaggaggccttctccagcttcccgcccctcagcctgttggaagaggaggcaggggagggtggccaggacatgcccgaggccgaactcctcctgatggtggctggggaggtcaagagcgctctgggcctggagttgtccaacagcagcctggggccgtggtggccgggcaggcggggcccacgctggcggggacagctggccagcctgtgggccctgctgcagcaggaggagtacgtctacttcagcctgctgcaggacctgagcccacacgtgctgcccgtgctgggttcctgcggccacttctacgcggtggagttcctggccgcgggcagcccccaccacagggcactcttccccctggaccgggccccaggtgcccctgggggtggccaggccaaggccatcagtgacatcgcactcagcttcttggacatggtgaaccattttgacagtgacttttcccaccgcctccacctctgcgacatcaagccggaaaactttgccatccggagcgacttcacagtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacaccaacctgtgtgcacttattctctgcagagagcacttgtacctggttatcccagcacgagttccagctgttctttcctgtaaatcgttaccacgttaaaaagtgtgcgtgtgtgcatacaaatgatgtgtatgcctgtgtctgggtgcaaatgagcatgtgagcatgtgtgagtgtgcccatgagtgtctgcatgtgtgtgagtgtgcacaggtgagtgtgcacaggtgagtgtggtgtgctcatgaggagtatgagtatgcctgagtgtgaatgtgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgcatctttagggaagggaatttgcattggagagcgtgtgtaacggcagcttatagtatttttcattttgtggaatccaccaaggttatggatgggttttagggcgcctcgtattgcaataca

SEQ ID NO: 461938 - DNA, 1447 bp, Homo sapiens
gacgcccgagagtttgtgcagcctgggagacggcggggggtttgattcaggggtgcccgtgggaaggggagggctgggtcgtcccagaacctactgactgtcctcgacccccgactctctgcatgctccggatctcactcccgggagggcccggagaaaacccaagttggggtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacaccaacctgtgtgcacttattctctgcagagagcacttgtacctggttatcccagcacgagttccagctgttctttcctgtaaatcgttaccacgttaaaaagtgtgcgtgtgtgcatacaaatgatgtgtatgcctgtgtctgggtgcaaatgagcatgtgagcatgtgtgagtgtgcccatgagtgtctgcatgtgtgtgagtgtgcacaggtgagtgtgcacaggtgagtgtggtgtgctcatgaggagtatgagtatgcctgagtgtgaatgtgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgcatctttagggaagggaatttgcattggagagcgtgtgtaacggcagcttatagtatttttcattttgtggaatccaccaaggttatggatgggttttagggcgcctcgtattgcaataca

SEQ ID NO: 461939 - DNA, 1944 bp, Homo sapiens
gattgaatctacccggatttctgggtgctcggggcgcgcggggtgttgctgctgctggacgccctccccgcacctccgccccaggcgcggggcctgccccaaccctcgcgcggcccctcccccgttccccctccccgccgagcgggcctgagccgcggagcagctacgcgagtgcggaactcggggcgcgggcggcggtggggcccgggcgcgggcagggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctgtgccaggactaccagggcggcacgctggccggggacctctgcgaggacctgtgtgtggcgggaaagctgctgttccaacgctgcctgcactacaacagaggcaagaaggtgctgcaggccgactggcgcggccggcccgtggtcctcaagtccaaggaggaggccttctccagcttcccgcccctcagcctgttggaagaggaggcaggggagggtggccaggacatgcccgaggccgaactcctcctgatggtggctggggaggtcaagagcgctctgggcctggagttgtccaacagcagcctggggccgtggtggccgggcaggcggggcccacgctggcggggacagctggccagcctgtgggccctgctgcagcaggaggagtacgtctacttcagcctgctgcaggacctgagcccacacgtgctgcccgtgctgggttcctgcggccacttctacgcggtggagttcctggccgcgggcagcccccaccacagggcactcttccccctggaccgggccccaggtgcccctgggggtggccaggccaaggccatcagtgacatcgcactcagcttcttggacatggtgaaccattttgacagtgacttttcccaccgcctccacctctgcgacatcaagccggaaaactttgccatccggagcgacttcacagtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagagtatgagtatgcctgagtgtgaatgtgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgcatctttagggaagggaatttgcattggagagcgtgtgtaacggcagcttatagtatttttcattttgtggaatccaccaaggttatggatgggttttagggcgcctcgtattgcaataca

SEQ ID NO: 461940 - DNA, 2155 bp, Homo sapiens
gattgaatctacccggatttctgggtgctcggggcgcgcggggtgttgctgctgctggacgccctccccgcacctccgccccaggcgcggggcctgccccaaccctcgcgcggcccctcccccgttccccctccccgccgagcgggcctgagccgcggagcagctacgcgagtgcggaactcggggcgcgggcggcggtggggcccgggcgcgggcagggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctgtgccaggactaccagggcggcacgctggccggggacctctgcgaggacctgtgtgtggcgggaaagctgctgttccaacgctgcctgcactacaacagaggcaagaaggtgctgcaggccgactggcgcggccggcccgtggtcctcaagtccaaggaggaggccttctccagcttcccgcccctcagcctgttggaagaggaggcaggggagggtggccaggacatgcccgaggccgaactcctcctgatggtggctggggaggtcaagagcgctctgggcctggagttgtccaacagcagcctggggccgtggtggccgggcaggcggggcccacgctggcggggacagctggccagcctgtgggccctgctgcagcaggaggagtacgtctacttcagcctgctgcaggacctgagcccacacgtgctgcccgtgctgggttcctgcggccacttctacgcggtggagttcctggccgcgggcagcccccaccacagggcactcttccccctggaccgggccccaggtgcccctgggggtggccaggccaaggccatcagtgacatcgcactcagcttcttggacatggtgaaccattttgacagtgacttttcccaccgcctccacctctgcgacatcaagccggaaaactttgccatccggagcgacttcacagtggtggctattgatgtggacatggccttttttgaacctaaaatgagggaaatccttgagcaaaactgcacaggagatgaagactgcaatttctttgactgtttttcaagatgtgatttacgagtcaacaaatgcggagcgcagcgcgtaaacaacaacctgcaggtcatctgtgacaaaatatttcgccattggttttccgcgcctctcaagagctctgcggtctctttccagcttcagctgcagttacaggaggcggtgcaggaatgtgcagaccctggggtccccagtgggaacacccggagagcagcctccagcgtgttctggaagcttcgccaactcctccaagccacactgagggagctgcaggaggcagagaagtagccactctctggccttaaacatgctcacacaggaaaagtgaccttggctggatttcttctgccattgttttaaagatgagccatttcccctgtgctctctggggtgccgttctggtctccacattgtggagtggcaagtgctgctgccagagacagtgctccctcgctctcgtcccaccctggcctctgacctgtcgccttgtgtaaaatgagatgagggaggaggtacagacctcccttcaggagggctctcggtcagaagacacaggtgagtgtggtgtgctcatgaggagtatgagtatgcctgagtgtgaatgtgtatgagtgtgaatgagtgtgtgcacatgagtgcacgggtgtcagcatgtgtatataagtgtgggcatgtgtatgtgattgtgtgagtgtgggcaggtgagtgtgttggggatgtgggttagggtggggagtggtgctttctctagtgtgtcctccggaacatcttgcctacctagcaaagaagtgtgaccattctttcggaattaaatacaataaaaagaaaataagctgcatctttagggaagggaatttgcattggagagcgtgtgtaacggcagcttatagtatttttcattttgtggaatccaccaaggttatggatgggttttagggcgcctcgtattgcaataca

SEQ ID NO: 461941 - DNA, 927 bp, Homo sapiens
gattgaatctacccggatttctgggtgctcggggcgcgcggggtgttgctgctgctggacgccctccccgcacctccgccccaggcgcggggcctgccccaaccctcgcgcggcccctcccccgttccccctccccgccgagcgggcctgagccgcggagcagctacgcgagtgcggaactcggggcgcgggcggcggtggggcccgggcgcgggcagggctggccatggcgcgggcggcgggcgcgcggggccctgccgggtggtgcaggaggcgcgggcgctgcgggcggggcacgctcctcgccttcgccgcgtggaccgcgggctgggtgctggcggccgcgctgctgctccgcgcgcacccgggtgtcctctccgagcgctgcaccgacgagaagagccggcgcatcctggccgcgctggtaggtcccgccgccgctctgccccgcgccgcgcgtccggggaggggggatcacacccgctcccggtccccagccttcccggggacttgggtggcggtggcacccgccggggacatgggttcccgacacctgcgtggagtgccagaggcgcacgccccggtcccccgaatggggacgcagccggcagtgctctgtgggcgcgctgggggtgtctctccccttttcgccagaattcgccctttgtccccagacagcctctccgtcctaccctcgccacccctgagcccgagctccggaagaaagtttgcgggtctgatccgagtgtccagggaggtgccgcgtccggtgtcaggccgccgggctcggggcgcaagccagtgcggggttcgggatccggggtgccacgcctctgtctctcgggtccgcagcgctccagcccagcccgcgttctgtgattccaccctgagctgccaggtcaccccctatctcaccgagcccatgcg

SEQ ID NO: 461942 - DNA, 1562 bp, Homo sapiens
tgtgctggaccgcggggaccctggcgtccctgcttagaacccacgcagcgtctcgggccggctaggggtacaccaaagcggacaaaagccactgaggggaaggacctcggcaaaacctgagtcctgtcctctcgctttcctccccgtacacagcgagcttcaccacttgctccgcaccttctccatcaactactacctgtccctgggatctgtccagtcgcccagctaaagtgctcagcaggtcagcagcgcggcgagcttctatgaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaacacccacaggatagtggacggcaaagtggtgtctgagaccaacatcacagacgtcttgaggtgctaaaccagcagaagcaaggtccctttgcggagcaggagggcaataaaaacttctgtggtcaaaaaaaaaaaaaaaaattaccctcgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagctcagtccatgcaggagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggttgcagttcgagccaaggcctttgcaggatgggatcgagcggtccctggaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactga

SEQ ID NO: 461943 - DNA, 501 bp, Homo sapiens
gtaaataattgtcaattttatatgtttcttataacaatgtaaacaataataatatctaagtgagataccgttttaatgcatttcaataattatcttcaggacctcggcaaaacctgagtcctgtcctctcgctttcctccccgtacacagcgagcttcaccacttgctccgcaccttctccatcaactactacctgtccctgggatctgtccagtcgcccagctaaagtgctcagcaggtcagcagcgcggcgagcttctatgaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaacacccacaggatagtggacggcaaagtggtgtctgagaccaacatcacagacgtcttgaggtgctaaaccagcagaagcaaggtccctttgc

SEQ ID NO: 461944 - DNA, 5318 bp, Homo sapiens
tggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttcactgtgggccactacaaaaggagatctagtctattgagaatagggctagtctatgcgaaaagagcctgtaaacagatcttggttatattcaaggatactgtttgtggatgctaaaataacaatgggtattgattttattactgctactgaatcaatgaatggatcaataaacaaaggtataaatgaaggaaaagattgcttatcctggatcaatgatgagtaccctggggtgtctgaatcttggattttgattaaaccctataactctgaggtccattacaaaaagagtacttttcattatgtctatgggaaatgagcttattccagaagctaacaataatcaggatttagtttttgggcttctgagtatggactgtattatttttagtaaagaagtatatggataaatcaagaaaaaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcactggagctgatttaaacattctttggtggtcacaagatgtatagctgcctctgtatgtttggcgcatggaaaaaaatatgagtttttgtggacatacactctttatttgaaaagtatgaaatataatccaagaaagccagccatggctcagtgataaatatggaattgatatgaaacattatattgattaatcacctttgaggatgattaataaaagagagaaagtgattctatatagagatgcaggactatttcaggctcattcatgatctaggtttttgtgcttcatggttattttattatcatcaataaaaagaaaaaagaaaaaaatcttatactgtccaaaaaattagggagaccagcgcccagtgttcatgtgaggggggactagtgtccatttccaccaagcagcctggaaatgctcatcctcacagggcattggagaggtttctcaagaagcgagtgcctccatgggggaaataattaaccccagattaaatgctgcttcagacctaatggatggtaaaaacaagatccaaaaggatcaaactctttccaggtagattaactgtatcccagaacaaagctcaaggacatttttagaaatacgtatatatccagcacacaagcagggtaaaattcacatctgcaaatttaccaggcattcaaaggggcaaaaaatacacaacccacaattaagagactaatgaattaatcaaaaccaacccagaacttatacagatgtgagcattagcagaaaaggacttgaagtagttattagaactgtctccctggccgggtgtggtggctcatgcctgtaatcccagcactttgggaggccgaggtgggtggatcacctcaggtcaggagttcaagaccagtctggccaaaatggtgaaaccccacctctactaaacatggaccaatgatgaccactggtggcgtttgagtcatggacgatgaatactacgtgtctgaaactctgaggtccaacagaaaacataattggatagatatcagaaatgtgcaaagatcatattcttactttggattaatagattgaggttcatcatcaatagataaatgatagaacaattaaacaagaataaataaaggtgaatcattgttcaattatgaatatacatgatgatgtaagaaatattatcactaaaaattttaaacacagatgccccttaaagaaatggatcatgagtcccgccactgcactccagcctgggcgacagagcgagactccgtctcaaaaaaaaaaaaaaaaaaaaaaaaaaaaaagaaatggatcatgagtatcagctctttggctaaggttcatctagactcttaataagtaagagtcagtttcattttctggttaagtctcatttgacattgttccttttgttatgagagaaaacatttccattctgaaaaattaatcaatataaaaataactgaataacagaaatatggaaaggatcaatggagataaggtttgaattttttctaaaagagttacctgctctttgtattctgcagaatggatgcacttgagccgacctaagcattcatggtcatgagatttgtggttgccactgttggttaggagcatagagatcagtgtgagtaataaagttcatgtctttctctaagagactttttaaagggtattcataatatcatgaatgtgtgaaaaattatccaaaaggccaacctcagccaatgataaatatgagattggttgaaacagtatatttgctagctcatttatgacacattgaggataattcatgaaagatatatcaaagtggcagattatatagaaagttgtggaatattctatgctcttactgtttggatattatatttacatgggttataatattaatattcatgaattaatgcataaataacatgtaaatgagaattaagctaaacagtcctaagcctgagccagtgatgaaaactggtggcatagaagtcaaggatgctgaataatgtgtgtctagaactctgaggttcaatagaggaggaaatatagtctattgcttttgaagtgatcttatagttaggttttggaaatacaaaagggccatcttcttggattgtttttgtgacttttgtttcttctttaaaataaattcattgatgtaataatcaatgtacacatgtaaaaaattaaagatgaggagtgtgaagcatgtccactcaatgtaaatggtgagacaacagaaatcattaaaatgtattgaaaatatgaataccatttaaaaaacgaacaattcaagtgtaatctttgactacggatgacataagcagtatagtgaagtttcttattttgcatcagaacaagtgtgctgttgttcatttttttaaaagaaaattgataagtattaccacaattaatagatacctgaatgactaagagaagggtcaaatgaatgaatccgtgaaaaatatttcaatcctgttaccttctctgctttgcacttcccagaatggacacacctgggctggcagaacatcttgccttgatctggagccccatgtctgcccctctgtagaggtgcacatgggccaatgtgagttaacagtaaaattattttttgcttttgcttatttgtttaggatattcagtgtaatatttaaaaaatattatatattaatataatcaaggaaggccagctatgtcccaaggatacgtatggacttgacatgaaatattgtgtagattaatagatattttaaacaatgaacatgatgaatgaaggaagtattaatatactaattgaagcaaatgattatgtagacagatactaggaatacttaaggatcttgtccttaaaacttggtgatccagaggtatttatgttattgttagtgaactaatgaatcattaggaaacagcttacaaataaaaggagaaaaagagggccaattctggctggattgatgatgaccactggtggcctatgagtcatacaatgaatacgtgtctagaactctgaggtccatcacaagcagtatctagcctagtccctctgtctgaaaaactcctgtagacagatgtcagggaaatacaagaaccttgttctttttctttatgtttatgaattttaaaaatattatattattaaaatagcaacgaagaataaacaaacatgtataaatgaatatagatgaggatgaagtattgtttattgttgaaatgtgtagtaaagagaaacaatactaatataaattgaaatggttggataattaatggaccaagtgtaatacatctttgactaaggatcatatagatagcagtaagtaatggttagttgcaagtttcacatttgttgtattaagaaaaaattaataaatactcaaatgactatgtaaatgaatggtgaaaaatatagattaatgtaaagaatattcaattttttaatcatcttctctgctttgcacttttcaggatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatattt

SEQ ID NO: 461945 - DNA, 2798 bp, Homo sapiens
atgattaatgaaaaaaacatggtaaatgactttatagactggtgttagggatacttaagtcatcttgttctcaagggttttgggattttgttcataagcgttttagataggtagatatttactttaatatgattagtttactgataaattaaccagtaaagaaatgtagagatgaatgagataaaagaggcccaagcttggaccaatgataatgactgttggggtatgagtcagtgaggttgaataacagtttgtatctggaaatctgaggtccaacacaataaaaaatttagtctaattactctgatggaaatccaaaataaaagggcaaaatctttgtatattcctaatatgtatttgatagcattcttataagtaaatcaatgatggaagcattaaattaatatataaatcaataagtatgatttattgtactatagatggtgaagctttattcaagtatcaatatatgtggtcaggcaagaaatattaataataaatgttgaaaacactattcccattaagaaataagtggatcaaagtgttacccttaatgatcatatagacactgataaataatagtcaactttattactgtggttcaaaccaagtggaggttgtatgttttgtctagaaaatatataaactacaaaaagttaataaacacctaagtgaatgagtaaattaaatgtggggagtaagattcaattaagataaagtcctaattttcttttaatcaaatgctctgctttgtactccttagaatggatgcactggagctgatttaaacattctttggtggtcacaagatgtatagctgcctctgtatgtttggcgcatggaaaaaaatatgagtttttgtggacatacactctttatttgaaaagtatgaaatataatccaagaaagccagccatggctcagtgataaatatggaattgatatgaaacattatattgattaatcacctttgaggatgattaataaaagagagaaagtgattctatatagagatgcaggactatttcaggctcattcatgatctaggtttttgtgcttcatggttattttattatcatcaataaaaagaaaaaagaaaaaaatcttatactgtccaaaaaattagggagaccagcgcccagtgttcatgtgaggggggactagtgtccatttccaccaagcagcctggaaatgctcatcctcacagggcattggagaggtttctcaagaagcgagtgcctccatgggggaaataattaaccccagattaaatgctgcttcagacctaatggatggtaaaaacaagatccaaaaggatcaaactctttccaggtagattaactgtatcccagaacaaagctcaaggacatttttagaaatacgtatatatccagcacacaagcagggtaaaattcacatctgcaaatttaccaggcattcaaaggggcaaaaaatacacaacccacaattaagagactaatgaattaatcaaaaccaacccagaacttatacagatgtgagcattagcagaaaaggacttgaagtagttattagaactgtctccctggccgggtgtggtggctcatgcctgtaatcccagcactttgggaggccgaggtgggtggatcacctcaggtcaggagttcaagaccagtctggccaaaatggtgaaaccccacctctactaaacatggaccaatgatgaccactggtggcgtttgagtcatggacgatgaatactacgtgtctgaaactctgaggtccaacagaaaacataattggatagatatcagaaatgtgcaaagatcatattcttactttggattaatagattgaggttcatcatcaatagataaatgatagaacaattaaacaagaataaataaaggtgaatcattgttcaattatgaatatacatgatgatgtaagaaatattatcactaaaaattttaaacacagatgccccttaaagaaatggatcatgagtcccgccactgcactccagcctgggcgacagagcgagactccgtctcaaaaaaaaaaaaaaaaaaaaaaaaaaaaaagaaatggatcatgagtatcagctctttggctaaggttcatctagactcttaataagtaagagtcagtttcattttctggttaagtctcatttgacattgttccttttgttatgagagaaaacatttccattctgaaaaattaatcaatataaaaataactgaataacagaaatatggaaaggatcaatggagataaggtttgaattttttctaaaagagttacctgctctttgtattctgcagaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatattt

SEQ ID NO: 461946 - DNA, 2339 bp, Homo sapiens
gttgctgtttagaaatgagtgtaaaacctaaaaggaggcgtatggctaagcatccatttccacttataaaggttttaatggccactgtaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcactggagctgatttaaacattctttggtggtcacaagatgtatagctgcctctgtatgtttggcgcatggaaaaaaatatgagtttttgtggacatacactctttatttgaaaagtatgaaatataatccaagaaagccagccatggctcagtgataaatatggaattgatatgaaacattatattgattaatcacctttgaggatgattaataaaagagagaaagtgattctatatagagatgcaggactatttcaggctcattcatgatctaggtttttgtgcttcatggttattttattatcatcaataaaaagaaaaaagaaaaaaatcttatactgtccaaaaaattagggagaccagcgcccagtgttcatgtgaggggggactagtgtccatttccaccaagcagcctggaaatgctcatcctcacagggcattggagaggtttctcaagaagcgagtgcctccatgggggaaataattaaccccagattaaatgctgcttcagacctaatggatggtaaaaacaagatccaaaaggatcaaactctttccaggtagattaactgtatcccagaacaaagctcaaggacatttttagaaatacgtatatatccagcacacaagcagggtaaaattcacatctgcaaatttaccaggcattcaaaggggcaaaaaatacacaacccacaattaagagactaatgaattaatcaaaaccaacccagaacttatacagatgtgagcattagcagaaaaggacttgaagtagttattagaactgtctccctggccgggtgtggtggctcatgcctgtaatcccagcactttgggaggccgaggtgggtggatcacctcaggtcaggagttcaagaccagtctggccaaaatggtgaaaccccacctctactaaacatggaccaatgatgaccactggtggcgtttgagtcatggacgatgaatactacgtgtctgaaactctgaggtccaacagaaaacataattggatagatatcagaaatgtgcaaagatcatattcttactttggattaatagattgaggttcatcatcaatagataaatgatagaacaattaaacaagaataaataaaggtgaatcattgttcaattatgaatatacatgatgatgtaagaaatattatcactaaaaattttaaacacagatgccccttaaagaaatggatcatgagtcccgccactgcactccagcctgggcgacagagcgagactccgtctcaaaaaaaaaaaaaaaaaaaaaaaaaaaaaagaaatggatcatgagtatcagctctttggctaaggttcatctagactcttaataagtaagagtcagtttcattttctggttaagtctcatttgacattgttccttttgttatgagagaaaacatttccattctgaaaaattaatcaatataaaaataactgaataacagaaatatggaaaggatcaatggagataaggtttgaattttttctaaaagagttacctgctctttgtattctgcagaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatattt

SEQ ID NO: 461947 - DNA, 2022 bp, Homo sapiens
tggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttcactgtgggccactacaaaaggagatctagtctattgagaatagggctagtctatgcgaaaagagcctgtaaacagatcttggttatattcaaggatactgtttgtggatgctaaaataacaatgggtattgattttattactgctactgaatcaatgaatggatcaataaacaaaggtataaatgaaggaaaagattgcttatcctggatcaatgatgagtaccctggggtgtctgaatcttggattttgattaaaccctataactctgaggtccattacaaaaagagtacttttcattatgtctatgggaaatgagcttattccagaagctaacaataatcaggatttagtttttgggcttctgagtatggactgtattatttttagtaaagaagtatatggataaatcaagaaaaaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatattt

SEQ ID NO: 461948 - DNA, 2101 bp, Homo sapiens
tggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttcactgtgggccactacaaaaggagatctagtctattgagaatagggctagtctatgcgaaaagagcctgtaaacagatcttggttatattcaaggatactgtttgtggatgctaaaataacaatgggtattgattttattactgctactgaatcaatgaatggatcaataaacaaaggtataaatgaaggaaaagattgcttatcctggatcaatgatgagtaccctggggtgtctgaatcttggattttgattaaaccctataactctgaggtccattacaaaaagagtacttttcattatgtctatgggaaatgagcttattccagaagctaacaataatcaggatttagtttttgggcttctgagtatggactgtattatttttagtaaagaagtatatggataaatcaagaaaaaatgaacagccccatctgatttaatcactgtgcaatgaccgtgaactgtacagttacctccgtgtgtcacaggaagactcttttgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaataatggacgcacctgaactgacctatgcatttgcaagctccacggctgtcccagtgtttggagcatggagaccgatttgagttatagtcagtgttcttgccttggttttggtggcttatttaggatacttactgaatacttttttaaaaagtattaaatataaccaaagaaggccaactgtggcccaatgataagtatggatttgacatgaaatattatgttgattgatcaatttttgtaacaatgggaatgattaatgaaagaggtatattcagtgatatcacatatgtcactaaatgaatgatgtgatcccatagatagatattaggggatataaga

SEQ ID NO: 461949 - DNA, 500 bp, Homo sapiens
tggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgatgaatagacgagattggatttggtcatttccccaaggtgaagagcatggcgatttcttctgtggtaaggagcaataatgaagaccatggttgatttaatcagtctctgctgatgaagatcttggctgttacctttgtgtaatgaatgcgcaatgattcaattattctccagcgaggaagatcatggttgttgtctgtttgagtaatgagtgtagaaacctatgtaagtaacaaagtgattgcttttgctttagtggttgttaagagagttaagtctttctggaaaggaataaatgactatgtatacaaataaa

SEQ ID NO: 461950 - DNA, 764 bp, Homo sapiens
agtctcattggtgcaatttccttaaaacacggaatagacatgcctccatgtgtaactatttaactttatatgtatgtgtgtatgcacgcatacacaattgttgagaatgtactcgaatccaggattcagattaatttaattctttctagcaagattcatgtagaaaggaaatttaaccctttcctagttgagtagaaggcagataaacagacagacgtgtttaatagtcacaattattattattttgcctggttttacttacagtagttaaatttcatacttgagtcaattagtcaatgaatcaatgttgttcatcttttaaatacacgacaagtaccagggtttatttctaatcaataattgttgacttgaacggaattttaaaaaaatctaaatctaggctgatccatttctctctatctctctctctctctctctctctctttctcatctacctattatattcaccttgtactccacagaatgaatgcgcaatgattcaattattctccagcgaggaagatcatggttgttgtctgtttgagtaatgagtgtagaaacctatgtaagtaacaaagtgattgcttttgctttagtggttgttaagagagttaagtctttctggaaaggaataaatgactatgtatacaaataaaatgaatgaagttatatgtgaatcattcagcacatctgtggtcagttaaggagaaaaaagcaagaccatcttattcattttaatagttaattattgagttaattaatgt

SEQ ID NO: 461951 - DNA, 2629 bp, Homo sapiens
  misc_feature (4)..(5): n is a, c, g, or t
  misc_feature (9)..(9): n is a, c, g, or t
  misc_feature (12)..(13): n is a, c, g, or t
  misc_feature (16)..(17): n is a, c, g, or t
cagnnggtnggnnccnnactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgccctccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagc

SEQ ID NO: 461952 - DNA, 870 bp, Homo sapiens
ttcacaggaaagcgggctatagcatgcctgtgcttgtcaatgaaaatcttagcactgagtttggagtgagtgcagatgaaggccgctggctttctgggattcttgatatgaaattccacaagaataacgaagacgatgacctttttaaggtcaaagagatattaattcaatgttttcattttactgttgaagacactgggacccacagaggtgaagtgacctgcccacaatcctgctgcagtcaccagcactctgtggtcagaagctgtccctggcggctgggggacgcacctgctcttactctccttctgcactggtccagctgccatcggttcttctggctaaactgtgtcttaaccacaaagctaaggatgctctggctgactaacgttctcttttcggattcaattggacatggttctccagtgcttcttggctctaattacggcggaatgtgcctgtgagttgtccaacagctgccacatccttgttaagacattaatgagagaagatcttgtgagaattgaaggaaaatagaaaaaaaatattgcagttgcaagagaagaatgatgcctgctccgtgggaatagtcaagccatgaaaaaccagccacctcatttcttccccagaagaccataagcacatggcatctcactttgaggggcaaattctgagtttggcactttatttatattttattaatgtaaacaataacaaaacacgttcaatcacaagcactctactcagccagctttatgtctacctctgaatcgaggcacttctgagatgcttctcagtgttagggaatgctggcctggaaggcttaggagccaactggcaagctcattagaggaccaagaattgcatcat

SEQ ID NO: 461953 - DNA, 936 bp, Homo sapiens
gggaagagccgctgagtaaaataacatggaaaatcacaaagtccttcctgctttcggtcacccaataatgtggagatcaagaatgataacaggaggtgcaggacctcagcctgtctctcccccggctccagctactccagtaaagtccagctggcataagaaacacggggtctgccgccacctagagatctccactagcactgaagtcccaggtggaagcatcacaaaacaggcacaaaatgcagtctcagcatctctgtatcaggagtcactgtctaagagtctctccagagaaataagctacccaggccatccagctgctggaatatccaccctcttcatcaagaacatcgtgtcattcttcagggtcacagaatgctctacagcctacttgctggtgtccaccaaggaggagattagttgcatctgaattcaaggaagattcgagagggctcacagctgcagaattccaatcactctcagtctgactgtgctgattttagaaagacacatggggatctgccacaaggaaggcactttgcagggaggcctcaaccccatggcacaccccttcaggagggctcttctccttgtaacagtcacttagccacttgtagaaaggcaaatcttagaaaatttaaatggggaccaaaatactaaccctaaccagtttattatctcaaagaattggaaaaacaaagttttcgaatactacgggattagaagagtaaacaagatatgccttttctttggagctacatatatgtattaaaaatgggatgtacaaagaattttttatcacatggagaagtgattatgagatgatataacattaaacaaattaatgaaaggcacacattaaaaagtataaccaaacttatacattagaactcaaaatttaaaatgtgtagaaaaatgattgagaggaaatatgcc

SEQ ID NO: 461954 - DNA, 909 bp, Homo sapiens
ttatagtagtaacattcagatgcaggctgctaacaatttaaatcaggagaattccagacctctgcaagaaaaaaatacagagtcttctgaaaatatgacaaaatttccctcttctcgtggaaaatcgactgtgagtttaaacaaaaataagcaactatctaatagtgcagtatttgtggtgtcaaataacaatttaggggtggtaaaaagtgctgttgacttccaaatgaaaggaaaagaaaatttaacaggcaaaggtataacacaaattttagggaaaagccatgggtcactaaaactgaaaagacagccacacatttttgaatcagatggagaaaccgaagatccacgactgctacagcagcaatcagaaaatcaagctaaagaagttggtacaagtgaccacaggttgatagtaagcaaaatagcccacaggtctaaaagaaaattatgtccagagtcttccaaaacttcaaagaagcatcattccgatactgtgcactatggccaatccagttcttctaagaagcagatacttgactcggataaatcaaaacttaagaaatctctcatcattcataatgcttagaacatggacctgaaagaaggaaatgtctaccagagatgagcattctgaatataggatgaacactcttccagatgcctctcacactcctgtgaccatgaaatcagctctacttactgctgtggaacctcctttttcacttgacagtttctttttattgtttgcatagcatcttgttgtatgtgggtttctgtatttaactagtcccctattgatagacacttcagttcttcccaacttttcactattacaacatcatgtagtctgcagatctttgcaaaatatccaatgatcttatacagtagttttgatagttgaaaata

SEQ ID NO: 461955 - DNA, 759 bp, Homo sapiens
gccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatactccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaaaaaaaaaaaaaaaaaaaaaaaaaaaaacacaacaaaaaaacaaaaacacacacacacaacacaaacaaaaacaaacacacacacgaaggggggggcgcgctccaaaattccccccaggggggccacacatcgccccccccagcttttgtggaaaacaaggggccccaaggggggggcgtctaataacaccgcagcgcggggcccgctaaacaaaggcgccgcgggggggacacacggcagcggggcccactgtggaggagagagacccctccagcggggggaa

SEQ ID NO: 461956 - DNA, 1426 bp, Homo sapiens
gccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatactccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcatagaaaactctgcttcacaaacacaggatattggaaatggaagtgggcttttcagtgctttgggaacaatcacaggagattctgccttggctgtaatccagaacgtatggagatttgaagttgtcgcaaacatactttgaaggccaccagatgcagctgtacaattgaagtccatcagctcacttgcctcaataaagcctgccactgcatgcagcttgtcacttgccactcacagatagggttttgatatgactctgcaagcaattgatttatgatggtctctgtgctgtcaaacctctctgctaatgttcatctgtatttgcagccactcccaagtgctagcatcgccgcctcagctccacttcaggtcatcaggcattagttagattctcataaggagtgtgcaacccagattcctcacatgcgcagttcacaatagagtgcgctgctatgagaactaatgccactgctgatctgacaggaggcagagctcaggcggtcatgctcacccacccacctgctgctcccctcctgctgtgcggcccagttactaacagtccatggacaggtactgatgagaatgtgaacacacagaggcaaagcggcccatacgaggtcacagtgagagagggtgccgtggagtcagaacgcacagcagggacccagcccctaggttccgtctctgagccccagaggcctgcaggacttatttcctggtccccacgggatgaaggaggaaacccgtgggaactagcacatggccctaaaagcaacctctccttgccctcattgtccattagcacaagacactcccatcagcaccatgacagtttacaaatgctgtggaagttgctgccttttccttagagatttccaaataacctgcccctaatgtgcatgtcattagaagtcagtataagtggctgtgagtgcagctgcctcagcccatatgctgctgactccgggtgcactgctgaggagtcagccctggcccagttcaggaaa

SEQ ID NO: 461957 - DNA, 1404 bp, Homo sapiens
gagacgctcaagagagcaagatgttctcgtgttgcttccccacttcgagaggttgctgcttcaggaatggagggagtgagagccttttccgacaatgccgaagaaggctcatccctcaccccagacgcctgtggccctttgtaagaaggcgcacccaggtaccacaggacagcccggggcaggccctagctggccaggccacaccatagatcccatcggggctgcctctgtacattgtccttgtccaggaggagattcgggagcccatggaggcacagacacatgctcctggtccatacgcagacatagcagcacttgcggcaccggctgtcgagccaaagccagcatgggaagagccccctccagagagagcgctggaggtggagggagctccagccaaggaccagcccagccaggagctgcctgaaatcatggcacctactgtagccactggccttaatgctggagctgaaaacgtggctggagagagaagtgggagggagggggtgacaagcacagccccagccagcagatcccatgctgcccctagtcctgggcatggtggcaaacatggaggcggagaccagggcattcagactggactcctgtacctcgctggagagaggcttctctcattcgctagaaccacagccctgctgctgcagggcctgtttattgtgctaatgctggtggggtatatctctgtgcaggtggtgctcaagagcattaaaacaaggctgggaagaagagttccagcagctcctcctgctctcagacgcaatcttctcctccaggcatggatgtgtgtctgcaactgggcatccaggctgtttgccccctaatgtgctgccccgaacgggctcttaacaggtgggcaggggttgaggggaccaggaggtggctccaaagggtacagcaaggaaagcttttaaagacagctgttgtgctccaggctctccatgccaccacctgccctagcatttattaatagtgttagaattacaagtttatgaaatgaaatataaataaagtttgatttctgaaacttctcacctttttgaactccctaatgttagatggtgtttttgaggctatcctgaaaatctcggatagttgtgtcttttgttgtggttgtttgtgtggctgaattaccatcgagtcatctgttattggaaacttttcaggcctctgggcccatgatgggagtggctgctgcaaagttcttcgacatgccctggagacattttccccattgtcctgttgattaacatttggctccttgtcacttatgcaaatttctgcagctggcttgaatttctcctcagaaaatgggttttttttttttctattgcattgtcaggctgcaaattttttgaacttctgtcccctgtttctgttttaaaa

SEQ ID NO: 461958 - DNA, 2853 bp, Homo sapiens
cctgtcccgtgtttggtgaagcttccctggctgcctgatggcaagcagctgacagcgcatgaagctgcaggcagttgtgatatttgacttggtttggatctgcggtctccaccaaatctcatgtcacctgtaatccccagtgtgggaggtggggcctcctgtaatccccagcgtgggagtggggtctagtgggaggtgactggatcatgggggtgggattctcacgaatgggttgtcatcatcccctctgtgctgtccccttggtgacagtgagtgagtgaattgccctgagatccgtttttaaaaggtatacagggtgcacctcctgcctgtctcgttgctgctcctgccacgtgagacaccatgtgagacgtttgctccgctttgccttcgccatgactcaaagcttcctgaggcctccccagaagcagcagctgccatgcttcctgtacagcctgcggaacctccgaggagtcccaaaacctcaaaagtcgggaagccgacagcgcagccttcagtctgtggccaaaggcccgagagcccctggcaaaccactcttgatgcccaagcccataaccaatcctgggaacaaagcacacaggagtcgtatggatgcaatgcacgtggatgtagcttccaggaaacaggccgtgctgctcccagaactggtggtgctgggcagacagcacacgtacgccacgggcagacctcctggagacactgtgggtgaaagagacatcagcccctgctgccggctgcccctcttcctcaagcctcgcttcccacctccgctctctggccgctcccaccccacgcactcacagttaatccgtcagctgggctgcctgagcccctcttgcctcactcattgtcccacctgctctagctgtgctggagagcccgcctttctgatgagacgggctcctctggttggcgtgttgtgcacagaagtccctctctgccggaggaagggcatcaaggcgcccgtcaacaagtggccacaacgcggcattttgaactgtaagatctctgggttgaacgtgtccggcagtcagtcagttggcagggaggctgaggagccttggaacagctccagggcagtggtggaaggacgcaccagaggagcggtggggatgtctgtggaagtgcagcgcttgacctcgctggaagaccggacgtggccactgtcttcctccgtgattatgtttcaaaggaatgaccggcctccagatcactgagaaagacactccctgggccttacaactggcaagatatgtcacaaaaggcttacatctcctttctctgccccttgtaaggggcagagaaagaatttacaatgacaagtttttctaacgcaaatgctccaagaaaaggcaggtggaggaatattcacatttttatcctggtactacttctggtatacctggtatggacatgctaacttaccattggattcagcggctctaacttattagtgggtcaatttctttgtaagattattgacactagagcagcccaatttattgctttgctgagtgcagggctgagaagccgaaggacacaaagctctcatctacgggattaggatcagatgcctaagtgtgaactctccaagcctcatgtgttgttgccatggcagttctactcaagagaccttttcggacagaaaagaagagtacttgctctggagggaacttgaatccttgtgccagttccccgaggccagcggctggtgcgggaggccgcttctgagtagaggagaaagttgcctgttgaacattcagtcggcaccaaggcaggcaggtggttttaagagaaaatcttctcaaaggcagatgagcccttgtctttacaatcaacatatttaattttagtggcaaatttatcctaattacattaataatgggcccctttactcttgtaggatataaattggacatgatagtattgagttcatagggttgtgatgggaatttaatgagattatgtgggttatacctatctacattgacttagaaattattttctcagaaattaaaacaggataatttattaatatatttaaaaccaataattataagcctgttgcatgtaaacagtcataatatctattttttatggaaaataattatatcttttgaaacaaaatcagtgatgagtgactattatgtttttatgatgtctagcttaacaggagacagctggattcttgtagctgcccctgcctttaatctgccatgatcgttctggctgaagtatatggagaaaattcaaccccatatagatgagtagttggaaaagggagagttaataaccttttcctgtgattgtggatgttttccttatctgtaccaaaactagacaagtgatagcttcttaatgattaattgcaacatgaaatctgagaccacattaacaaacttttaaaacttttatattaaaattcatttgtcattcttactctttgaattcatcttgtttccctgcaattatacaatttataacatcaagcatttgtcatttagaaaattcattccaccaaattgtgcagatcttccaaatattgacgaatatcatgaatttttatcattaaaaatcacattccttaatatccccattgattgtatcagaaaacactttatctgaaatctgtcaagtgctcagaggcagatagacattttccaaaattcagattttcactctagaccttgagttgtgttcttggcaagagatggtgtcagttgtgttccttgaggtgatgggctccctgcattcatttctgagaaaataccagccataaactcaagtctggattcccttaggttgtccattatcctacttccagtaaaaacc

SEQ ID NO: 461959 - DNA, 1738 bp, Homo sapiens
gaagtcttcctggggaatggcatgagacaccgagcatggccctgacaagtgccgctctgactcatttcctgagccgtacccacgtggcttctgcccatcatcccagccgtacccacgtggcttctgcctataattccagccatacccgcatggcttctgccacttgtcccggccgtacccacgtggcttctgcccatcatcccggctgtacccacgtggcctctgcccatcgtcccggccgtacccgcgtggcctctgcccatcgtcccggccgtacccgcgtggcctctgcccatcgtcccggctgtacccgcgtggcctctgcctatcgtcccggctgtaccccgtggcctctgctcaacattctggctatacccacgtggcctacctgcgtggcttctgcccatcgtcccagccatacccacgtggcctctgcctatcgtcccagccgaacccatgtggcttctgcctatcgtcccagccgaacccgtgtggcctctgcccatcatcccagccaaacccatgtggcctctgccccatcatcccagccactactgttttccaaagtgaagttgcagtcactctgccgaggcccggacgaggcactgctgacttgtaagcacatgctgcagatatggaaatcctgctacaacctcaccaaccccagggccagagtggggaggaccctggctccaggcagtgtctggtggggactggcggatggggtgggcggtagaggccccagtggtcactcagaattccccctccggctccccgcaaagcctggagggaggagtggtgaattgagcagcccttattaaggagcatcctgtctggttttttaacttgattttctctgggatagaaataaatgtttctcctgtagcccttatcattatgtaaatgtagtcatccccgccagcctgctcgtttcccagtcttcccacccccttccagatccaccccaggctctgcacaggcctccagggcagtaagatgaggaagacgtgggcagtagcagggagtgagtggccaaattgagaatagaccctagcttcatattctcagcaacccgttccctcttctcgatttttgcttaaagggggaaaaaaattacactgagctagtcactaaactgagcattggaaaacttgcaaatagtgttccacctgcagttggagatgcgtctcttgctgtgagcaaaatggtgggtggcattctcttacatttggcgaggtgtttgtcatttcagaagcctggattctatttctctcggtctgcagttttgcttgcatttaggatagaaatctgtctcatgctttgtcttctgtcactgggtgaagtgtaaggctccctcagtccttgtgcatattgacccagccactcaagacagtgtgaattctgaccagaatctcaccagaaggtcccagcaggctccctgaactgaatctcacagcatttcagccagggatggtaataaccacgtttattgaaacttctccatgccagcactgtactaggccactgatgtgttatcttcaatccctacattagccttgcaagatagctaccgttacttccattttacagaaaataaaattgaagctaaaagtggctaaataacttgcccaagtttttccaattgaatatgtagcagaacagtgattcagccccaggcctaacatcaatgctctctccacactggcatgctgcctctcttgagctgacaaccagtttc

SEQ ID NO: 461960 - DNA, 1291 bp, Homo sapiens
ggttgactctgcagatgatgatgcagtgcctcctttatgaaagatttctgaggacttccccacttcttcctacttgcggggaagataataaggagaaaagatcaaggaaccagaaagcttctagaggcatgagatgtcggattccaataaagcactcagaaggagctgatcttaccgttttggtttgggtagtagagcgagacatctcagtgctttcagtttctacccctttccgcatcccactaaaccactttttatattccattcgaacctggaaatttgagtagagaggtccgtgttacatccagagcttggtttgggagaaaggatcctaaaatgggaggctaaagataaagacaccaagccctactctctagttttccatataatcttggccatgcccatgttgattcattttatttaaactcaaacttctcagttgtaaaaaagatgtgtattaaatatcagacactataggactcaatagatgatgatgatgatgatggtgatgaaggtgactgttgatgatagtgatgatgatggtgatgatgaaggtgatggtaatggtgatgatggtgatgaaggtgataatgatgaagatgatgataaaggtaatgaaattgatgatggtgaaggtgatggtaatggtgatgatggtgagggtgatgatgaagatgatgacaatgaaggtgatgatagtgatgatgatggtgaaggtgatgatgatgaagttgatgataatggaacggacgatggtgatgatgaaggtgatggtaatggtgatgatggtgatagtcatgatggtgatggtgatgatggtgatggtgatgatgaagatgatgaaggtgatgatggtgaaggtgatgattataaaggtgatggtgatgacagtgatgatgataaaggtgataatgaaggttatggtaatggtgatgatggtgatggtgatgatagtaaagatgatgaaggtgtgataaagccttacctggcgattaaggagacagtgtaccacaaagagcaacactccctgaagggtgttgatgatggtgaatgagtatgcaatgattgatccaatcgtcttccctacttcttcaaccataaaaaaaccaaggccccaagaacagcccaggataaatagctgagaaatggctttaaatgtcatgactctgcagggaataaaagtaataataactacggtttaccaggaatatttattgaataaggaaatgaagttacctgaaaatcagagtttctatttcttctataaattgtccttcacatgctctttatc

SEQ ID NO: 461961 - DNA, 1932 bp, Homo sapiens
cacagcaagatttgctgtgatttcttttattgccccaagcgtacctcaccttgtcttaaagtgtttgctctggatgttacaatatgtgtattgtaatatagtagtctactggtaccagtatttaccacttcaaaaggagctctacggtgactttgaagacttggaaacaggggacatgcacaagggaaaatcgggccccgacactcagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacaggagaatgggagcagaggaactggaggctgcaactgtggaaaacttttgtggggttttgctgcagagagaagcagagaaatgaagcagtttttggtggaagaagtggaatcaaaaggttttgagctgaatcacgtagaatttgaagatcaagatgatgaagccagagttcagtatgatggttttcgacctgggatgtacatccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttggggtaaaatatgattacaataacttgcctattgccgagattaaactttacaggctgcgttattttagctttgtgcttttcctttcataaaattccactcctaagatgtttctgttttctgggagcagggaggtggtttggagtatatatgtaaatctatatccaaatctaaatgtccgtatccagtatgttaaactagaatctaaaatttctggtttgctatatttctttttttccttttcctttaagaccctatcactccacagggaactggtttcttggcaatacagtctgtcagtggcataatggtaactatcttggacaatttcttttacagattggtttgagaaatatatcctgaatgtgggttattatgtacatgagactttaagttgaaaattactcatttttattattataaagtaaatttccctttgcttttaatctttgtacatccttttcagtagggtgtgggattagaggaggggaggtggaagaattataatggtacatttcctatttttgtgcatcttttgcatttatttatctaagcaagtatttaagcagtgctcaccgtgtgctaagcactatatgaggctgatccctctgggggaatgggtggtgggggccagatgtttccttccctcctttatgtgactgtcctgttttccgggctctactggatttctgctactccttgatgcactctggggctctcctttagtgactttcatcaaaatatagctgtttgctgctttggctgtctttgtcaggggatgagtgcaaggggttattgatcagccccttgctggcatcactccctcttaaacttttcactggatactcttttgaactattttttcccccaccatatacatgtattttttaaacgttaatgtgctaatttctactgaagcaatgtggatttttctgaaagttttaatgttttaataagctttttattgaaatgttaatgtacatacagaagagtgcccgaatcataagtgtgcatctagatgaactgtagcacaccaggctgccacgccctggaccaagcagtagccttgacctgtgg

SEQ ID NO: 461962 - DNA, 745 bp, Homo sapiens
  misc_feature (1)..(1): n is a, c, g, or t
  misc_feature (3)..(4): n is a, c, g, or t
  misc_feature (8)..(8): n is a, c, g, or t
  misc_feature (12)..(14): n is a, c, g, or t
  misc_feature (17)..(17): n is a, c, g, or t
nanntatncctnnnatnggactcgattagtttctgctagtgtggagacaagtcatgtcatggctaggggccatgatggtaggagcagtcagaggatttcttgcattgtggcccctgaaaaaaatgttaccatcagggtgcgctccctgattcttgtgtctgctggaaggaggaaatcaagccaggaacattgtcaggatagagatgaaaatagggctcacttttctgtctcttgtgatgtcagacaagcctttcagctctgtctcctcagccctcatggaattgttgaagctgggaatgacccgaagtttacaaccaggaagaaactgaggatctacaaccacaaggaactgaattctgccaacaacccagatgctcttttagagccttcagaaagaaatgcagcctgccaacatcttgatgttatttcattgtatcatttctatattgccagagcacctacagttgcatttctttctgtcagctttatccagcatttgtttttgtcttttatttgaagttaaatatattccttgctcactacaacactgggggaaggaaggtttctgttgtcattgttgtgcttgtacagttgtgtatttaaaaacattggcgaaaacaaaaactgtacgtagatggaatggagataagacagaaaatgagagagactgatgatgagtgtgcctattctagactgggaggggtgctacactgaacagtgtctccaaggctgcaggaaaggatgg

SEQ ID NO: 461963 - DNA, 5378 bp, Homo sapiens
aggcagagtcggatagtgcagggaagcgtgttctactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagcacgaccagacagggactatgcgaggggctggtggacagcagggtgcacagatcaggctcaccctggtcccacaggaaagaaagccctgttctctccaggtctggcagcttatacagctctgaagaaagacctggcctggcgagagaatttggggatagtcagccttgtatttaaaggcatgaggttgggtgagatcaaagtgaatagactgaatagagataaagaagttcaaaagactggggccctaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccaatcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttctta

SEQ ID NO: 461964 - DNA, 5373 bp, Homo sapiens
aggcagagtcggatagtgcagggaagcgtgttctactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagcacgaccagacagggactatgcgaggggctggtggacagcagggtgcacagatcaggctcaccctggtcccacaggaaagaaagccctgttctctccaggtctggcagcttatacagctctgaagaaagacctggcctggcgagagaatttggggatagtcagccttgtatttaaaggcatgaggttgggtgagatcaaagtgaatagactgaatagagataaagaagttcaaaagactggggccctaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccaatcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaagaatatacctggatatttctctttcttctcaaattattctaaggttatt

SEQ ID NO: 461965 - DNA, 1595 bp, Homo sapiens
aggcagagtcggatagtgcagggaagcgtgttctactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagcacgaccagacagggactatgcgaggggctggtggacagcagggtgcacagatcaggctcaccctggtcccacaggaaagaaagccctgttctctccaggtctggcagcttatacagctctgaagaaagacctggcctggcgagagaatttggggatagtcagccttgtatttaaaggcatgaggttgggtgagatcaaagtgaatagactgaatagagataaagaagttcaaaagactggggccctaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagtctgaacctgagtccgggaaacctggattctagtccctgctctacaactaattagcttttggcattgggcaaaccatttaaccttgcaaagcctacatatcttcacctctaaaatggagatgtaatataataattcctgccctaccagcttcagaagattaagtatcaagtgagataatacatgtgaatgcgttttgg

SEQ ID NO: 461966 - DNA, 5431 bp, Homo sapiens
aggcagagtcggatagtgcagggaagcgtgttctactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagcacgaccagacagggactatgcgaggggctggtggacagcagggtgcacagatcaggctcaccctggtcccacaggaaagaaagccctgttctctccaggtctggcagcttatacagctctgaagaaagacctggcctggcgagagaatttggggatagtcagccttgtatttaaaggcatgaggttgggtgagatcaaagtgaatagactgaatagagataaagaagttcaaaagactggggccctaaggtatggtctgaatatgcgttgcttggcagctcgggtcaactataagactttgattattatctgcgcactcttcactttggtcacagtacttttgtggaataagtgttccagtgacaaagcaatccagtttccacggcgttcgagtagtggcttcagagtggatgggtttgaaaaaagagcagcagcatctgagagtaacaactatatgaaccacgtggccaaacaacagtctgaggaagcattccctcaggaacagcagaaagcaccccctgttgttgggggcttcaatagcaatgtgggaagtaaggtgttagggctcaaatatgaagaaattgactgtctcataaatgatgaacacacaattaaagggagacgagaggggaacgaagtctttcttccattcacttgggttgagaaatattttgatgtttatggaaaggtggttcagtatgatggctatgatcggtttgaattctctcatagctattccaaagtctatgcacagagagccccctatcaccccgatggtgtgtttatgtcttttgaaggctacaatgtggaagtccgagacagagtcaagtgcataagtggggttgaaggtgtgccattatctacacaatggggacctcaaggctatttctatccaatccagattgcacagtatggattaagtcattacagcaagaatctaactgagaaacctcctcacatagaggtatatgaaacagcagaagacagagacaaaaacaagcctaatgactggactgtgccaaagggctgctttatggcgaatgtggctgataagtctagattcaccaatgtcaaacagtttattgcaccagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccaatcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaagaatatacctggatatttctctttcttctcaaattattctaaggttatt

SEQ ID NO: 461967 - DNA, 4128 bp, Homo sapiens
cggtcagggttttcaaggatgaattgcaattcaatttcaaatacaaaagtgcttttattctaaccagtctttgttggtatattctcccctacagaaaccagtgaaggtgtatccttgcaactgggaaacacaaaagattttattatttcatttgacctcaagttcttgacaaatggaagtgtgtccgtggttctagagaccacagaaaagaatcagctcttcactatacattatgtctcaaatgctcagctaattgcttttaaagaaagagatatatactatggcattgggcccagaacttcatggagcacagttaccagggacctggtcactgacctcaggaaaggagtgggtctttcaaacacaaaagctgtcaagccaaccaaaataatgcccaagaaggtggttaggttgattgcaaaaggtaagggattcctcgacaacattaccatctctaccacagcccacatggctgcattttttgctgctagtgattggctagtaaggaaccaggatgagaaaggtggctggccaattatggtgacccgtaagttaggggaagggttcaagtctttagagccaggatggtattctgccatggcccaagggcaagccatttctacattagtcagggcctatctgttaacaaaagaccatatattcctcaattcagctttaagggcaacagccccttataagtttctatctgagcagcatggagttaaagctgtgtttatgaataaacatgactggtatgaagaatatccaaccacacctagctcttttgttttaaatggctttatgtattctttaattgggctgtatgacttaaaagaaactgcaggggaaaaactcggaaaagaagcaaggtccttgtatgagcgtggcatggaatctcttaaagccatgctgcccttgtatgacactggctcaggaaccatctatgacctccgtcacttcatgcttggcatcgctcctaacctggctcgctgggactatcataccacccacatcaatcagttgcagctactcagtaccattgatgagtccccaatcttcaaagaatttgtcaagaggtggaaaagctaccttaaaggcagcagggcaaagcacaactagagctcacaaccaaaactgcacttcagcctctgctgtacacagaaactacaggctctgtctcaggagagcataggcacattttaaaaggttatgtactaggtttttgtggattctatcaaagtgataagtgatccttaaaaccagccttctaaaataattgcattccatgggttgggtatttagaaatgtaggtggcatttagaacacaatgtttaatcaatgggctgaacaaagatgcttcactttgccttgcccatcaccctatacagtttcgcagatagtctagtcactctatgtgagaaagataatggtaagtagttgctactggccaactgtctagcacttacctgaaaacttagtatggagctcttttaaaatgtgattatttatatttatgttgaaagcggactttaaaaaaaataatgtgctgtaacacagtaaatatgtacttgtagcctggatagcagactgtgttcaactttttaaaaagatgtttcctttctaaagattaatttcttgggagcaaatgagtatttgttgcatttgttcaatttgttgtatatggtgaatatttaattatggttttcttgaaacgtgtaaattaaaaacacaatcagtgttcaggcttcagttatataatgtaagcacaactaaaatgaaacttgttgactgcacaagaaattacaaaaatgtttctgttttgaaacttgatctacaatcagtaaaagtttgataatcagtatatcccttcccaacccccattgtgacagtttctttttgtcactgtctagaattttgtattttatttcagactataccttggagttttgtatattttgagagagatatttttgggacattattttggaaacttattacaaatctaaatttggaaaggagctagtagctttaaggccaccaccatattttacttttttaggatttttccccctttaaataaaaatattagatcaaatactatatgcaagaaatcatagcaaagtttttttttcctaccaagatcattcttgatcatcagcttcccaaactagtaagtctgtgcatcattgggtgtttttttttaatttaattttaaattatcccagctattagatagaagggatgttactgcacttatgtgtaatcagatctttatttaggtatacatatcctcctataccgcacataaatagatttcagagcccccatacaatgggcagtgtctgctatagggcttcaggcattaaataaaaccgagggttgttgattttgctgtgacagtacactaaatcaatactatatcttatacagtttgaaaatatgataccctacactttcaggggaccgagtctgacaaacacaatacatttatctgtgacctatatcaagtacacatttaggagccaggtaggttacctgcttacacactatattttaattgaattcaaactatcaagcactacttagaaactggaaaacatatatatgttagcatcaaagggggcagaagcaaagaagatacagatctgcactgaagacattagactggccatagaaaagtaagcttgaactcccaattgatgtgaccacactcttcttaattttgttcacagtaaaaacacttttttgagttattaggcttacccctagcttttgacctttgcatttcatatatgttagatgtctcagcaagaatatctggtctcccctaatttttattcccagtgccgatgttcaaaataaactttctccagtctgggaaccttttttacttccccatatttgttattatttagaatggttcatacgtctgctttgtttgcatactggtcttcagattatgagactcgatgataacagtatggtactgcttctgtgacaaatatcgtgccttaacaatgtggctgtccttttccactgaagaaggaaagacgttttgatctagaaatagcgttgtgatttccttgctgttggttttacactgccttccacattgcaacagcaagttgatttcttgtgatcccagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgggggcatacagggaggaacactgccctggactatccattgcatttttgcctctaaacaactacagaattttctagggttttaaattatgtaaaatgtttacttattctgagcttagagagaatggggagggtatttttaaattttattgttttatttctttaagtttttctttgctttaagattataggtattaggtttgtttttgtttttccacttatcttgagttcactttgatgttaaatctattgctacttcagttgtaaaaccagccaaaagtttctggatgaaggtcaagtttgaccttttaggagttattgtacataaaggcttcatccacgaaccatccagcgcacagaagcaagtgcaaaaatgacacaagcacaactctccagacgtggctccttctcctttctcagtgcagactctcactgaaagctgctattttcatcctccttgtggttgcttttcttgtttctcttccattgtacatgtgggttatataccatatgttaaatatgcaataaagtgtttacaggatgcccttctgaagggtagtcctttgtaaagctgtacagactttgcagtttaagcacaatgtgcacatgttagttttatatacagcaaaacttgattttttgcagatggaaaggtattttgtttctatacaaagtaaatggattgtttgtgcttaatgtaaagccgctttataaaactgtaaaataaagtttttttcttaaaaagaatatacctggatatttctctttcttctcaaattattctaaggttatt

SEQ ID NO: 461968 - DNA, 3858 bp, Homo sapiens
tgctagtgtgtatagactaatagaacccatttagctttgaacatgttcaacttctcatctttgttcttcttcatatactataggctgtttgctgtggtttagtcaaaaagccatgtagaatgcctgccttttgaagaccacttttaaggtgtctagtaagacagcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctccagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtcagcaacatcttcatgtgtgttttcttttgtgtagttttcattgtatgatatacagatccattatttccatgttttcaacatagttttcttatctggagcagcattttcttagctgtgttttctccaagttctgtggtcaagtaagttaggggaatgc

SEQ ID NO: 461969 - DNA, 1879 bp, Homo sapiens
  misc_feature (3)..(6): n is a, c, g, or t
  misc_feature (19)..(19): n is a, c, g, or t
ttnnnncaagcttggcacnaggccagcagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtca

SEQ ID NO: 461970 - DNA, 1271 bp, Homo sapiens
cggacgcgtgggtcgacccacgcgtcgcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtca

SEQ ID NO: 461971 - DNA, 2201 bp, Homo sapiens
  misc_feature (12)..(13): n is a, c, g, or t
  misc_feature (73)..(73): n is a, c, g, or t
  misc_feature (151)..(151): n is a, c, g, or t
agcccgcgcganngctagttttgcccacgcacttttggcacagccgcgccacgcgatcggcgatctgattggnccgcgcgggagggcgcgcggcgccaaacttgcttcccgtcagcccccgcccgtcccgcgggagcgcgcacgctcgcgnacccggatcccggctcctgcatccagtcgccattcgggaggccgctgcgctgcagggcctcgcggagcgcccgcgaccgcgagccgggccctccgcgcggtccatcgcccactggacgccgcccgcggccggaccggttcaacttctcatctttgttcttcttcatatactataggctgtttgctgtggtttagtcaaaaagccatgtagaatgcctgccttttgaagaccacttttaaggtgtctagtaagacagcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctcatctcgaggagataagcaggagtgagagttgatattaaaacatggaggctgagcacacagctctttcctctgccccgcgccacctggagagagccgcgtcctgggtacg

SEQ ID NO: 461972 - DNA, 3945 bp, Homo sapiens
  misc_feature (12)..(13): n is a, c, g, or t
  misc_feature (73)..(73): n is a, c, g, or t
  misc_feature (151)..(151): n is a, c, g, or t
agcccgcgcganngctagttttgcccacgcacttttggcacagccgcgccacgcgatcggcgatctgattggnccgcgcgggagggcgcgcggcgccaaacttgcttcccgtcagcccccgcccgtcccgcgggagcgcgcacgctcgcgnacccggatcccggctcctgcatccagtcgccattcgggaggccgctgcgctgcagggcctcgcggagcgcccgcgaccgcgagccgggccctccgcgcggtccatcgcccactggacgccgcccgcggccggaccggttcaacttctcatctttgttcttcttcatatactataggctgtttgctgtggtttagtcaaaaagccatgtagaatgcctgccttttgaagaccacttttaaggtgtctagtaagacagcagcagtattgaaagtttttaaagaatataaccgtgtgtgttggtaacagacagaagaatggaagcattccaggaacttcgtaaaccatcagcacgtttggagtgtgaccattgcagtttcagaggcacagactatgaaaatgtacaaatccatatgggtaccatccatccagaattttgtgatgaaatggatgctggtgggctaggcaaaatgatattttaccagaaaagtgcaaagttatttcactgccataaatgcttcttcaccagcaagatgtactctaatgtatactatcacatcacatccaaacatgcatccccagacaaatggaatgataaaccaaaaaatcagttgaacaaagaaacagatcctgtgaaaagccctcctcttcctgaacaccagaaaataccctgcaattcagcagaaccaaaatccatacctgccctttcaatggaaacacagaaacttggttcagttttgtctccagaatcgccaaaacctactcctcttactcccctggagcctcagaaacctggctctgttgtttctcctgagctacagacacctcttccttctcctgagccttcaaaacctgcctctgtttcttctcctgaacctccaaaatcagtccctgtttgtgagtctcagaaacttgcccctgttccttctccagaaccacagaaacctgcccctgtatctcctgagtcagtaaaggctactcttagtaatcccaaaccccagaagcagtctcatttcccggaaacattggggccaccttcagcctcatctccagagtcaccagttctagctgcttccccagaaccttggggaccatccccagctgcatctccagaatctcggaagtcagcccggactacctcccctgagccaaggaagccatccccttcagagtctcctgaaccttggaagccgttccctgctgtctccccagagcctaggagaccagcccccgctgtgtcaccaggctcttggaaaccagggccacctgggtcccctaggccttggaaatccaatccttcagcatcatcaggaccttggaagccagctaaacctgctccatctgtgtctcctggaccttggaaaccaattccttctgtatctcctggaccttggaaaccaactccatctgtgtcttctgcatcctggaaatcttcatcagtctcacccagctcctggaagtctccccctgcatctcctgagtcatggaagtctggcccaccagaactccgaaagacagctcccacgttgtctcctgaacattggaaggcagttcccccagtgtctccagagcttcgcaaacccggcccaccactatccccagagatccgtagtccagcaggatctccagagctcagaaaaccctcagggtcaccagatctttggaagctttctcctgatcagcggaaaacttctcctgcttcacttgatttccctgagtcccagaaaagttcccgtggtggttctcctgatctctggaagtcttccttttttattgagcctcagaaacctgtcttccctgagacccgaaaaccaggtccttctgggccatctgagtcccccaaagcagcctcagatatctggaagcctgttctctctatcgatactgagcctagaaaacctgccctgtttcccgagcctgccaaaacagcccctcctgcttctccagaagcacgcaaacgtgccctttttccagagccccggaagcatgcccttttccctgaactccccaaatctgctctattctcagaatcacagaaggctgttgagcttggtgatgaactacaaatagatgccatagatgatcaaaaatgtgatattttggttcaggaagaacttctagcttcacctaagaaactcttagaagatactttatttccttcctcaaagaagctcaagaaagacaaccaagagagctcagacgctgagcttagtagtagtgagtacataaaaacagatttggatgcgatggatattaagggccaggaatcaagcagtgatcaagagcaggttgatgtggaatccattgattttagcaaagagaacaaaatggacatgactagtccagagcagtctagaaatgtgctacagtttactgaagaaaaagaagcttttatctctgaagaggagattgcaaaatacatgaagcgtggaaaaggaaagtattattgcaaaatttgttgctgtcgtgctatgaaaaaaggtgctgttttgcatcatttggttaataagcataatgttcatagcccttacaaatgcacaatctgtggaaaggcttttcttttggaatctctccttaaaaatcatgtagcagcccatgggcaaagtttacttaaatgtccacgttgtaattttgaatcaaatttcccaagaggttttaagaaacatttaactcattgtcaaagccggcataatgaagaggcaaataaaaagctaatggaagctcttgaaccgccactggaggagcagcaaatttgataacacagtgtgaatatttgttctacaaaggtgtttgttggaaccattctttgtaagtatagcttatcagatagcatagttggatcagtagatgacatgtatggtgtaccgtgtttcactgtctcagttgtgttactaagaatgagcatttgatcatttttttctggtctctgtctatgtgactatcttgtaagtcaataaatttctgtatagtccagatggattaaacttctcatttcttttaaatatgtatgaataataatacaaggaagtaggcattccatttaataatcaagagcaagttgtactcaaagcattcagttaaagtgtatctgtgtgtggaactaatttcagacaatagaaaatattagttgaaatgtttaagaattaggcatgaaaaataaatttgagaaattttgtttccttacatgtatttttaaatcataagagttattttctatctgatgtaaaattagtttataaatcttaatcagcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatccccaccccccacccaccgcctgccagctcacactaatagatgattcttaattgccaaatgtgttagagtttgtatatcctactcctgggccttacatgtcgcctgttggggcttaagaccaggttgataagtaggaactgaaagtcttccagattcacagtagaaaattttatagacatttctgttaaagaaatatatcgattttatgtttttcaattatgttactgtaaataccttgtacctgttcatggattattttattctaaaatattttgtcaaatgtgtatcaaccaaattaaaaagaaaggttttcatgtca

SEQ ID NO: 461973 - DNA, 2145 bp, Homo sapiens
actttcaacctacttaggtccttaaaatgaggcttggaacgcggagcgcattgtgggcctgtcgtgggtggcgccagcagcacatgcatgcctggctcacagagcagcctttgggtgttcttttcccagaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttggggtaaaatatgattacaataacttgcctattgccgagattaaactttacaggctgcgttattttagctttgtgcttttcctttcataaaattccactcctaagatgtttctgttttctgggagcggggaggtggtttggagtatatatgtaaatctatatccaaatctaaatgtccgtatccagtatgttaaactagaatctaaaatttctggtttgctatatttctttttttccttttcctttaagaccctatcactccacagggaactggtttcttggcaatacagtctgtcagtggcataatggtaactatcttggacaatttcttttacagattggtttgagaaatatatcctgaatgtgggttattatgtacatgagactttaagttgaaaattactcatttttattattataaagtaaatttccctttgcttttaatctttgtacatccttttcagtagggtgtgggattagaggaggggaggtggaagaattataatggtacatttcctatttttgtgcatcttttgcatttatttatctaagcaagtatttaagcagtgctcaccgtgtgctaagcactatatgaggttatgaggagccatcagagaccacccagacacaagactccctgcagctgtgctgggctgccacaggagttgtccttgatctggataaatccataaaaattgtgaagaaattaaagctaactggttttccatataaaattttcaagaacacttcatttattaagatattgtcttcatgcgaacttggtatcctgtttccatcccagccttctataacccagtaacatctttgttgaaaccagtgggtgagaaagacacctggtcaggaatgtggaccacgggccacctcgggctcgcccatggtgtcagactaaagacaaacaaggactctctgtataaggtactggtcgtgtgtgtgttagtggagatgaagcctgtgccctacagacagggagtcacgcagacacttttctataatttcttacgtactttgaatgttcaagtataaagtctaatgttaaatttgattgaacaattgtatatttgtgggatattttggaatggaacaccaaaaaatggtaatagtggttctttctggattgaagacaaacttttcttttttaaaataaattttattttatatatttgaggttgacaacatgatcttaaaggataaatatagatagatgtttgcatcagtatttaatttattggagaagttgacctgtagtttttgtttggtgtgtgtgtgtgtgtgtgtgtgtgtgtgtgtgtgtgtgtgtgtgtgttttggtttggcttaggtattaaggtgatactggcctggtaaaatgtgtttggaattatttcctctcactctgtttttgc

SEQ ID NO: 461974 - DNA, 2123 bp, Homo sapiens
cacagacagtggtatctgtgagcagctctgtggactcaaaggttttctccctgagaggcgtaacccaggccagctgattcatcagaatcaggaaactgggcatctctgtggtccctgagcatcccaggaggccgactgtacagagacctctggtccctgaccccagtctgcctccacatccctggaatagcccatcatgggcccttcaaccttggcaggtggacaccattcaacatgctggggcaggatggacatggtagaggatgtggatactttgcaggagtgagaggacatcattatgaagtatgagaacgtacagggacaccgagctgggctgccagcagacacggggcctaaagcctgttggaatctacagcagcactgatcgctttgggattctgcagctgagccctgagctggatgggacagagccagtcctttctgggggtcggctcccagaccgagatggctccaaaccttgtgcaagtcctcagctctgcctgggctgcattacagtgagaaggaactgcccggtcagagcccgggaggtgaagcaaatgcggcaggagatgagatgaaagagcaagtggatggaaatgctgggagaatgggagacatatcagaacagcaaaaaagtaatgtgtggagggagaggcccccagaaccactctctgcagagacaggggacaggcacccatggctgtggcctggcaccgtcagcctctcagagggcaggtggcacacagtgctcacccagaggaccgcaggcctggttgccagctttactgcccgttcatgcaagcatcaccttgctgagagggaatctgaatctagggctggggatgcctcctgctgacccgaaggaaagaaaaggtccagatcagagttcaggactctgagtgcccacacactctttcaatcctgcgaagggagaccctgtcccagcttgacctcacctttaccgaggaatcatggggccaaaaccaaagatttccaggatcctcgggctctggtcctggctggggtcatcccatggcctgtgacaccagatcgttttctgcccacagctaattgattgagtgtataagggcattcccatgaacatccagggccaggtgtggtcagtcctcctgaacattcaggaaatcaagatgaaaaatcccagaaaataccaggtcatgaaggagaagggcaagagatcctctgaacacatccaccaggtctacctggacatgagctggacactagggaaccacatcttcttcagggatcgatatggagtcaagagcccggggctgacccccagagcccaagtcagacacctttcatcttcatcagcagaaggcatctcatcttccccaaggccgccctctgcccaggctccagcttcccttggtacccacaaatgggccaaccaagcccagatggcagcatctccccatcccgtgtcccctggcccggccccacttccaggagacgaccacgaagcccagcacccaccctattctggccaccccctgtccccaaatggcgggacagttcaggggctccaagaccatcaggagcatgtggtacccatgtaacaacccaagaccatgtgtcatctgatctctctcgggctcaccccgtgcctgtgggacatatatttgctggaaggggaacagatgttgatgctgataacaagcactgcctttaaggttcagaggagcaagtccacgtgtgcccagtggggcctggggagcactggggtcagaccccaactagcccaagggcagcttcctcacactgttctcatgattctctgttctggcccagagggaggtctggccaggtgggctgggcagggcacagtgacaccaagcccatccctcacatgacccagatgaaagtcaggagtgtgatgagcacttccctgcccaggctgcctccccagccacagccttctgtgcacatctggacccctggggtggccacaaaaggatctggcactgcccagtgggagactgaagtggtcacggggtgtgggctctgacccttcccagggaactctcctggcctgatacccaccttgtccctagagcgccacatgaagatgtccaggtctggcctgtgggcacgttttc

SEQ ID NO: 461975 - DNA, 1869 bp, Homo sapiens
  misc_feature (25)..(25): n is a, c, g, or t
cttatgtcgggtgctgtgcctgggntcacgtagatctgagaatcgtgcgagacaggcttcaaggccattcggagctcctgtccaaatcggagtctaaaacttggaggctggccctgggccaggccctgcaccaggctttccagactcagcccttcaggagcctgctgtctagccccactctgtgtccagcagggtcaaggccttcagcaaggctgttctcctctctggccctctgttttctcctctgtaagagtgttggctctgcgggtgggttctgggattttcttagagagcagtgtcagatctgtggtgtacgagcaaatagcctgaggggaagccatacagcccactgggctcagctgggagcagggcatcttctcccagggggtgctcgcatcccccagagaccatcatgctaatgctctcaagcattccccaagagcctcttctgtaccaggcccactccaggtgccgtacatgcaaagacaaatcatggtggtccttgctgttaaagagggagatggaggtgaagagtcagccaactactggcatcacggaagggccccccctcctctcggagcccctcacctacaccctgagcccccagtgtgccatctgtggccagcacaactgcagctctggccacagccagctcagcagcactgtcatcttcccaaagggagacaaaggctgctgctcagggccgctacccagaaacctcccttccctcatagttacgttggaacgttctcgggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccacactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggactcatagcctgtgtcattcgtaaaagctcaaagacctgagaaaggcttagttcctggggtggggagctgtctgtacctgggggcccactctggacatgtcagcccttgacact

SEQ ID NO: 461976 - DNA, 2217 bp, Homo sapiens
ctttcccaccgtctgtcacagtctggtctgtgccagtttttcaatgtattgactctcatctccaagtcaccctgcattacctgctttgtgataatggagctagacactttaagcatttctcccttgtggggcatgagtgggatcagcatggccattggcatcagtggcatcagctcctccgaggccccaggggggatgaagggcagctcattaggatccaaggcccaaggcaacctgcgccatgatgctctcaccggttttggtgaagaagggggtgacgaagacaaagaagacatcaaaggccagcagggccagcaggaaggaggagcagttcttgagagtgggcagccgcacacggtgcaggacgaacaggcagtaggaaatgcccagtgtgtcctgcaggagccacgcccagcggtcctcattgcggtaggccacccagaagatgatcacggttgcgcacaggctcgccagcagcagcagaggcagcggcagagaggcccagaggctgtgcggaggcctctggccggcccagtagccgcctgcagccactgtgcccacagccaggatgaagatgaccagcatgttgtagtcgatgatgggctctgggggtgcgtacatggccacgcggacgacggcctccccacgagtgtggctgaggatgtccagcatgtcagcatagtggagcatagccacagggatgcactgttggtcactgacccggctcacgatgagcagcccgtgggcaccttggccctgagccagccagcctttcgtgtggaagctgcagttacccctcatgaccatggcagtggtctggcggaggggccgctggctgggggagcggagctgggcctggtggggggaatcctcacccgggcaccagggtgccttggtgccatcatacaggggcaggagtggggcgtggtgcaggtcccgggggagggtgatgtagtcggagctgaacaggatacagtagtccttgctccaattctccgacaccacgtgggccacgccgtactttcccccggccacggtgctgatgaggaggaggaagcccacggggaggaggaagcccaggcacgccatcttcttcagttcctactgcaacatctgcgggcggcagcccaatacccctcccaggggcaggcgtggccctttgtcacagagcagtctggccacctgtcctggaaaccagggccacacctacctagtcataaagctgtgtggtccccagccgagggcgctgctgtggggcacagggtccctctagaatgatgccccccaaccctgggagaccaggggagaggtcatatggaccctgctctctgcccagaccctagtgggtttagaccaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtgagaggtggatttgaagccaggagccccaggttttggctctgcaggtttgcacccagctctgtggtgtatgccctcacaggtcacccaggacctcctgtccaggcttcttcaggccacccatgatggagtagatttgaggaatgaggttttcaaagcagttagtgtgcgggagagtaaccctggggcctccggaaccagaagggagggatttgggggctggagcttggcagtccaggttccattgtcctcatgttctccccactggcctggcctgtcactccagtctctgcataggttgtcacatggcattctccctgtgtgtctctgtgtctcttctcttctttataaagacatagttataatggattagggcccaccctaatgacaccatcttaacttgattatgtctgcaaacaccctacttccaaataaggtc

SEQ ID NO: 461977 - DNA, 1139 bp, Homo sapiens
agcggccgccgagtccgtccacatcgccaggccaggaccttggacagggcccagcacaggggccctggaatgtggactgtctcagtggattcttgtttataggaattagaggaaggtggaagaagctcattccagagtgcaatcaataacagtggaaagaagtccctggagcccagtgcagtggcttgaactgagaatgcactcactggctgttgcagccaagactccagttctcgcctctctttccctgactcccctgtgcccacctttcccctgcaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtgagaggtggatttgaagccaggagccccaggttttggctctgcaggtttgcacccagctctgtggtgtatgccctcacaggtcacccaggacctcctgtccaggcttcttcaggccacccatgatggagtagatttgaggaatgaggttttcaaagcagttagtgtgcgggagagtaaccctggggcctccggaaccagaagggagggatttgggggctggagcttggcagtccaggttccattgtcctcatgttctccccactggcctggcctgtcactccagtctctgcataggttgtcacatggcattctccctgtgtgtctctgtgtctcttctcttctttataaagacatagttataatggattagggcccaccctaatgacaccatcttaacttgattatgtctgcaaacaccctacttccaaataaggtc

SEQ ID NO: 461978 - DNA, 895 bp, Homo sapiens
agcggccgccgagtccgtccacatcgccaggccaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtgagaggtggatttgaagccaggagccccaggttttggctctgcaggtttgcacccagctctgtggtgtatgccctcacaggtcacccaggacctcctgtccaggcttcttcaggccacccatgatggagtagatttgaggaatgaggttttcaaagcagttagtgtgcgggagagtaaccctggggcctccggaaccagaagggagggatttgggggctggagcttggcagtccaggttccattgtcctcatgttctccccactggcctggcctgtcactccagtctctgcataggttgtcacatggcattctccctgtgtgtctctgtgtctcttctcttctttataaagacatagttataatggattagggcccaccctaatgacaccatcttaacttgattatgtctgcaaacaccctacttccaaataaggtc

SEQ ID NO: 461979 - DNA, 1028 bp, Homo sapiens
agccccagtctgcggagagggagggcgaggggcggcggcgcaggggtgcacagaggcggacggcgaggcagatttcggagccgcggcgcttacctgatagtcgacagaggcgaggacgggagaggacagcggaggaggagaaggtggctgtggtggcggcggcagaaggagtcagaacaaggacgggcctgtgatgtgtctgtctatgacgaggaggacaatgtcctaaggaatggagaggaagaaagtgaagggaaccaggtccctggattccatgtggaacagtagcccaggatgtgcactatggactgttacaagagagagacatgatcttccttaaggcattgatttgtcatgagtctctttgttatagccacttaacgttaccttaatacacccacttcatggataagtaaaactgaggcttggagaagcccacattgacacagcaaagaaggctggggctcttgtgctggttaaatggaccttgatgtcttccaaatgttttcatgctggattctgagccactctcctggctgcaactctgaggccgggcagactttccgctggaaagagaactcaaatactggtgagaggtggatttgaagccaggagccccaggttttggctctgcaggtttgcacccagctctgtggtgtatgccctcacaggtcacccaggacctcctgtccaggcttcttcaggccacccatgatggagtagatttgaggaatgaggttttcaaagcagttagtgtgcgggagagtaaccctggggcctccggaaccagaagggagggatttgggggctggagcttggcagtccaggttccattgtcctcatgttctccccactggcctggcctgtcactccagtctctgcataggttgtcacatggcattctccctgtgtgtctctgtgtctcttctcttctttataaagacatagttataatggattagggcccaccctaatgacaccatcttaacttgattatgtctgcaaacaccctacttccaaataaggtc

SEQ ID NO: 461980 - DNA, 703 bp, Homo sapiens
tgccctaatgaaggtatggtgtcacagctttttcctccccacatcaggctcttctatcgctaccaggacctggccccacagctcgtgcccctcgactataccacctgccccgatgtgaaggtgccctacgagctcattggcagcatgcccgagctgaaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggagctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcacccgctgtggactctggtttctgagaataaacacaagtcactgagtcacacctgctgggaggacacatttttccaccttaaaactggaagatgggagggaggcggcgtagaattttatctttgactttgct

SEQ ID NO: 461981 - DNA, 519 bp, Homo sapiens
  misc_feature (506)..(506): n is a, c, g, or t
  misc_feature (511)..(511): n is a, c, g, or t
  misc_feature (513)..(514): n is a, c, g, or t
  misc_feature (516)..(517): n is a, c, g, or t
ccttgatcccccgcatggcaagcatgaagctggccaacccggccactttgctgagtctgaaaaacttttgcctgggtaccaaagaggtgcctcggctgaagctccaggaaagccgggacccaggttccagcggcccctcttccccagaaaccagtttaagtaggtccgggactgcacctccaccgcagcaggacctggtgggacacagggcaaccgccctaacccctgattcgtgcccgcttcctggccctggggagccaacacttaggagcaggcaggacaggcactttctacagcacctgttggggatgggcatgaactactgtgtgagggcactgggcatccatgaacaaaatgaatcagttctaagcatcagtaaacaaaagagaccaggtctgaatcattgtgaaatattttagtgagcggagataggttcaattgaataaatgaaaaaatatactatttcagatggcattaagtgctatggagagcaataaagtggggtnaggananngnnag

SEQ ID NO: 461982 - DNA, 3657 bp, Homo sapiens
gtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaagaacacaaacagaacgggcaggataaggactcttccataacaagactatgaagccacttccacatcaattccaggccacctaatcccatccgaggaggccatggggaggaggagggaggggagtgggctggggggagagtctgttttctgtgcactccctgtgactctggcctttcttcttctttttttaattgaccaatttttagttaaaaaggcaaaagaaggtgaatttgagatttacagaaaacagttccagtgtttggtttccgctgtctttcctttcatttgccatgtttttacattcttccaaatttggggtcactcccctagctcctgatgctgctactgtaccatccttttgctccagccatgagagcagacattgcagaatgttggttccaggttggcatgctctgaagctcttgaactgtagcacaggcagagccctttttcttcctgtcatctccacccgattccttccatccctacgtctaccactctctgggtcctcactggtcttcaaaggacctggctctcataggatcccctcaggattgtgtgcagggagagggggctttgctggggaggagctgggagtggagagttggagggtgggtggggttccctcatccagtttccacagcccaccatggctggagccaaatgctagaagcgagattgagaacagtggccgtttagtgatgtggtttacctaataccactgtccagctgtgcagctcagaaaggataaaccagtcagggacaggggccagaacaggtttgggaaggtggcagcaagcagagcatggtgggtaggagatgatccctaaaaaaactggagactgtggtggtctgagctggtcaggaatctgcagaatcccttccaggaatcagtgtgccagtgcccacagcagggtgagctaggagggagaaatcccaggaaaaaggtcgtgagaacccagaaagccactccatgaggaggcacggtgaccacagctgctaaaggttcttaggctgccttcctgggctaggaagagccccccagggagagcttccacaaaagggtatgtgtcaaaccttttgtcagaataaataatagcatttcccacccacccccatgccctgggccacagggacttggtgggatcagcacacccatggatcagcttttgctgtcttagagacagccatccccatgaaggaatggtaaggacagccactgctcagtgaagaacagccatttggaagagccacgctggagccctgcagccatagaactattcacactggagttttaaaagaaacagcaataccataagctctagtagggaatcataatcaggaaaggaattcacaacataaaataggtgttctgtgctattaatcatgtaactttgtatatgatgtatagcaaagatactgggaggttttgtttcatccttaaatcagaaatgaatgctagtttcatagctgggcagaaccctcatccccaccccaaagttttccttttctttcccgttcccccaacccaaagatcagactactgttaagtttcaccacacaattggaattgcaaagacgggaggcaaatggagtgattttcatcaatggaattgcactgacagtgagtgtttcttataggattactaaattttttaatataaaatgatttgtttaaaaatcaggagttgatattaagtaccaggacattagttcggatgatttcatttttatttctacagtgttaaaagtgcacttatatgctggtttatttacgtcttgggaaaagagactgcaaattgaagggatgattgttactttttctttttttaaaaaaaaaaggttaaggagattttaagacttataaatgtttaagaaattataaacaaggttagaccctttgaaaaaaagtttagaagatattcttaaagtaaatttttatagtgttaattttgtaataatttatgttttactatattacagagctaactgaccagaatagtttcagaaacaatatgaaacttaggaaagtttaagcaatgtttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttgaattggaagctggaataaagagcccccacccccccccccaccctcatcgaatgctgcttactttgtcaaaagactggctatgaccaaggtgaggatatttctggaaaactgggcaaaaagggaaagcccacagtattcttccttggcagtcaaccacaggtttactttacaatgatgtattaaaaacttgcagcttgaaaaatggaatgcaaataaaaggttctctttgggtttgtcttaatggagttaaactggagcagcctataaaacatttttagggtgatgtcctctgggtccttctgttctgcacacccactcagttttctctcccagccccttgactgcacacacccctctttgcatgaagatctcctgacttgtcgccagccatagaggattgaaagctctggttgtaaagcaaaacgcaatgcatagacctgtcagccataaaaaaaaaa

SEQ ID NO: 461983 - DNA, 6279 bp, Homo sapiens
  misc_feature (1)..(2): n is a, c, g, or t
  misc_feature (8)..(8): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggtgaaattatagccctcctttttttttttttttttttagcatatctgaatgtaatttgaactggtcatattcataataaaacaatttattgataagaaaatggaaatttcccttctttttttgctaattttcattgtaactattccaatgtctccatcaatttccttgggagactcttttctacaaaatgtcttctctgaaataatcttttatatgtattgtatttttcattactttcaaaatgtgtctctgatttttcaacatagttgtatttgtctaaagttcagaaatttgacctaaaagttaggatgagtccaacttattttcccaaaaagggatcatagtattatattatttgtctgaacccttgaattgagattttaaacataatcttttgctttgttaattctgaaataaaaagaaacaccttttctaaaatgtcttctaggccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaaggtaaggaagcgcctttctaacactgttgttctaaataggcctcagacatctgtacctacttacaggttgtgatatacttcagtaggtttttcgacttaggatctaggttctccagaaagattaatggaaaaaaaaaaagaaaaaaaaaacagagcctgattacatctttacattctaaaaagcatttttattttttcttacctttaaaaaaaattttcaattcaaacagtatttttaatagtatctcctgttgtgtttggactttgtaacctaactgcactactgatttctttttggttttgagctagtcatggacgtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattc

SEQ ID NO: 461984 - DNA, 10430 bp, Homo sapiens
  misc_feature (1)..(2): n is a, c, g, or t
  misc_feature (8)..(8): n is a, c, g, or t
  misc_feature (5523)..(5523): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaancagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattc

SEQ ID NO: 461985 - DNA, 9953 bp, Homo sapiens
  misc_feature (1)..(2): n is a, c, g, or t
  misc_feature (8)..(8): n is a, c, g, or t
  misc_feature (5523)..(5523): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaancagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgta

SEQ ID NO: 461986 - DNA, 8727 bp, Homo sapiens
  misc_feature (1)..(2): n is a, c, g, or t
  misc_feature (8)..(8): n is a, c, g, or t
  misc_feature (5523)..(5523): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaancagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggtaaggaagcgcctttctaacactgttgttctaaataggcctcagacatctgtacctacttacaggttgtgatatacttcagtaggtttttcgacttaggatctaggttctccagaaagattaatggaaaaaaaaaaagaaaaaaaaaacagagcctgattacatctttacattctaaaaagcatttttattttttcttacctttaaaaaaaattttcaattcaaacagtatttttaatagtatctcctgttgtgtttggactttgtaacctaactgcactactgatttctttttggttttgagctagtcatggacgtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattc

SEQ ID NO: 461987 - DNA, 1361 bp, Homo sapiens
ctcgtaccgatacgctcctgacggcaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgta

SEQ ID NO: 461988 - DNA, 7180 bp, Homo sapiens
  misc_feature (1)..(2): n is a, c, g, or t
  misc_feature (8)..(8): n is a, c, g, or t
  misc_feature (5523)..(5523): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaancagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagtaagtttgggaaagcttatggcaaaaattcggcaaggctgcttagatctttgctttctactaggtcggtagtttttcatttgtttttccagtgcccctatcagtgtgaacagatgcttggcatatgagatgtacctttaaccagatgcctgattttcttggatagctcattatctgattctaaattatgcaaagaaccacactgagttagaatgtattaatcaactttattttgtatctcattaatatctacttcaatctcttgtatgcttcttgaagtcaattttggcatgtcccaccagaacagagagttcttttgaaagaaaagaacctgggttccagatactcaatacatcttaatatgaatgtgtttttgc

SEQ ID NO: 461989 - DNA, 987 bp, Homo sapiens
ctctggatgcaaagtgtctctggatgcaaagtgtcctctggatgcaaagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgta

SEQ ID NO: 461990 - DNA, 445 bp, Homo sapiens
gggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgc

SEQ ID NO: 461991 - DNA, 559 bp, Homo sapiens
caagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccc

SEQ ID NO: 461992 - DNA, 6868 bp, Homo sapiens
  misc_feature (1961)..(1961): n is a, c, g, or t
aagtaattagggaaaattctgttgagttctgatcggaaggtaaagtgcgtcctcctgtgtgcttggcaggtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaancagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattc

SEQ ID NO: 461993 - DNA, 3836 bp, Homo sapiens
ttaggatcgcgaccaagcgtccggtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattc

SEQ ID NO: 461994 - DNA, 5941 bp, Homo sapiens
  misc_feature (1)..(2): n is a, c, g, or t
  misc_feature (8)..(8): n is a, c, g, or t
nnatttcntcaagccgacgcgggtgaggtgtgcgagcgcgcccgggatccgcactgagtgaggttccgcagagccgggagacggaggaggtgggtcagcctgggtcgctgcccttgtccagcgcaacccaagacacctgcgcgccgggtggagccagggctaggggtggggcctgggctccgggaagggggcgggcctgccttcctccagtgcaaatgcgtcctggagtggtttgtcctacgttgcggcccgtagaggcgccgactcaccgcctcttctccgggagtggcggagattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggtgaaattatagccctcctttttttttttttttttttagcatatctgaatgtaatttgaactggtcatattcataataaaacaatttattgataagaaaatggaaatttcccttctttttttgctaattttcattgtaactattccaatgtctccatcaatttccttgggagactcttttctacaaaatgtcttctctgaaataatcttttatatgtattgtatttttcattactttcaaaatgtgtctctgatttttcaacatagttgtatttgtctaaagttcagaaatttgacctaaaagttaggatgagtccaacttattttcccaaaaagggatcatagtattatattatttgtctgaacccttgaattgagattttaaacataatcttttgctttgttaattctgaaataaaaagaaacaccttttctaaaatgtcttctaggccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggtcagtatatacaatgaagggttagaagtttgcctgcacatcttccctagaaggcagggaggtggcagccgtagcctgtgcgcgtcatgacatgatgctctgtggtggtagcacagtgttccctttcatgtgccctacttacgggaaaatggtttcatgtgccaacctccaaatttttgtaggcagttgtctagatcgctgctactgtcattgtagaaaagtaa

SEQ ID NO: 461995 - DNA, 1472 bp, Homo sapiens
gagctgccgtaagaaacactcgcccaatcatgtttccccatcgaggtgccgtgagaaacactcgcccaatcacgtttcctcatcgagctgccgtaggaaacattcgtccaatcacgtttccccatcgaggtgccgtaagaaacactcacccaatcacgtttccccatcgagctgccgtaagaaacactcacccaatcacgtttccccatcgagctgcctgccgtaagaaacactcgggttctgtggtgccttcagaggaggaaactgaggctgagagaagtccgtcaacttgcacaggaccacactgccagcgagtgacagagcgaggatttgagcccaaggcccgtgctcttaagctgtgtgttgtcacgtggaaacagcatttcccgcccagcctggggatttccaagctggaaattcaaacagctcagcacggaataggctccaacagggtcaggacctgccaccagccacagctgaagaggctggggcgtcaaggcagaaagccaacatcccggagtcatacaagtgcacgttctcttcccagctctggcacataccagctgtgtgaccttagcccgttttatggaaatctttctaagatgtactaggagcacctcctttttccagatcaacgtagaagtgtcttgtaaacttcgatgactcggtgctgtggaagtaaggagacctctttgtccccacactgcctgaccgcggcgtgttggagctgcctccttctccagccccagacagccctcccagcttcctcttgaatctgcagccggttacccctggggagaccaagccttgctggtggaggggagataaacaagctcaccaaatcattattcttaatttgcaggaaggccaaagctccctctgagccgagctctaaagacattttttactgtttagaagcctttgattcctttacttcccagcaactggctgagttcccagggctgaagttgccttgaagtttgactgctgaataagaaaaagagttttcctctgttttgttgttaatccagagtttgagctgggagcataaagatttcaaacataccaaataggatttcttcaactagattgttttggaaaatacaaatatgagatctgagaaggacagatacaaaagaaaaagaagtctcagttccaggctaaggtggacggaaagggggtgccctaaggaggctcgaacctgagacagtctgaaccagaaaaacctcccctagagtttgggggctggcgtgcagctgctcacatttttatcttgctaaattaagaatataaaataagaaccattggataagatcacccttattttagaaaagagaggggaaaagtcaaccaaaaaagctgtttttttttaaattaaagggatttaactttatgaaaaacttcctacattgccctgtgcttttcttattttgtcatgggcaactgtgttttatgcagttttatatgctatc

SEQ ID NO: 461996 - DNA, 2933 bp, Homo sapiens
aaaaaaagaagaagaagaagaagaagaaggaggaggaggaggaggaggaggaagaagaaggacagacctgtaatttttctgtctttaatatttttgtcaagttttgcccccaaccccccgacaggccccagcgtgtgatgttcccctccctgtttccatgtgttctcattgttcaactcccacttatgagtgagaacatgcgctattttattgcagctcgtcaagttctccctgcattggtttgctccctgttgcctataaaagatgttctacttaacccttttcctgtttgccccaagaatacttgccagcagcacttgctgctgcagtatttaccccaagataactttgccacgaactctcgcttttattattactttctagtggtatttccatttacaaagtataataattctcgatcgctgaaaatgtcgaatcctagaaaatgtagcattcctacacgtgatgttaacatcattctcgaacagttcttggacagagatttatttaatgaattcgatttttctgaaatagatgattttgatgattcagatgcttctgatactagatctgtttagaaataacatcaagaacagtttttatattttattttcacattgaaaatcagtcagatttgctttagcctcaaagaatgtgtttacgtaaaattaaatgaatgctggcagtgagctgtactttttttttctaaaccggaaaagggttaatatagctttcatcgttgttttcagtaggagggctagtccaatcacaagctactctattgtggccaaaagcaaaaatctggtggtaatcatttttaatcgccattgttgatttctccgcagtggcttctggcattgataacttggttgtcacatggtcatatgtgaaggcacccggtttattcatttgttcctttgtccattaaatagtttttgagcacttctttcaggccaggtattactctagacacaagcaatataacaatatttaagataagatctgtgtcactttggcacttgcagcctgtttttatagaaaggctactaaatggttgccgagtcggacttgtggtaattaaaatagacttttcttgtgtgggggttgggagtgagaaaaaagagactggaatcttttagatgattacatcttctttatataaatatttttagccttttgaaaaaactctgtagagcttaatgcagttcacagttcacccacactacatcaatatttggcctaccttttgcaagcccaattccctaactatgagtttctgtgttacataaaaatctcaccgggagcacaattatttgacaatttgagttgaaactccaggaactgatttatggagaacaaacttagctctgaaattatgtctctttatgaatatcgacatgaaatctgatgaagaatcatcctactgtggtttcccattttaacttctgtttttgaaaaacatttcagatgcaactaagcacttattaaatgcttcgtgataccaaaaaatggcttggtggtctttgtcttccagaatagcataaatttcagtgttaccaagataaaaatataatctgggcacatgtcactgttaaaatattatagtcagatcaaggattctattcctgtctttgttattctttcccacttttgaaactttatccagtggatttttttttattacaaagacgtattccagagataacagtttgtacttctgattatgatccatgttcatgtgatcaaaaggcagcaataataggacactgtcatatatggtagctccatagaaactaggctgcactgggaggacagattcgccatcttgagcacctgtggcttggtattctcgaaattgtagcccctttggaatggctgaagaactaccagttaaaggtaaagaaaccagacacacaaggccacgtattgtatgattccacttacatgaaatgtccagaatgggcaaatccatagagacagaaagattagtgtttttcaggggctggtgggagggggaaatagggagtgacaatgtatacaggtgatggggttttggggtgatcaaaatgttctggaattagccccatcatatacatttgaaatatctttatcctagataatctgtattcatttgaatgcaaaagttttatcaatatgagtgaacttatacatctttttattcgctgatggagatatcacttgaaactttgttcctggcaaagcaaagagatgaaatgtattgaaaaaaatcgattagacttttaaaacttcaaaatacttttatagaaaatgtaaataagattgtttctaactgcagagtgttttacataaaatctttatgtgaagaatttatattgcagtacaataaagtcagtgctttttatatgttttgaatggtaaacattttgaaggtattttttgaagtaactaggtattgacattttttaataatatattttgaataaagcacacctaaaatgcatgaacttgtgtaagtatttggcatcattagtctagttgtacatatttttaaaaataagaatgggcttagaagataatgtatttgtaacaccagtcacaagtccaggcctctggaacttctgaccaaccagctttaagctggggggtctcacaaccccctctttgggttgaattaatttgctagagctgctcacagaactcgagggaaaacttaagtttaccagttgattataaaagatattgtaaagatacagatgaagagatgcatagggtgaggcacgtgggaaggggtgaactgacgggtgcctgttgagggcctgctgaggcccagcccatgggtgatgggcgccctgggggatgcaacgagcgccgaggcacaaactgtggcacctgggactctaagcccaccaggaagggatcagggagaagctgacgcccagagtgaatggtcc

SEQ ID NO: 461997 - DNA, 1775 bp, Homo sapiens
cattttgttaggccttctcaagtgggaatcaggaacgctgctgtgctctagagatgttttgttcttcctgtagggctgaagcagtgcctactcgatagaatcagtcatcatgcaaataaaagccacctgagtcaaaggcaaagccagagtgcagcttggagcaaagaagttaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggcaacgtgaacaggaggataggctacatgaacaggaggagaggctacgtgaacaggaggagaggctgtgtgaacaggaggagaggctgtgtgaacaggaggagaggctacgtgaacatgaggagaggctgtgtgaacaggaggagaggctatgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcagcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggagctggagaggctgcgggagctggagaggctgcgggagctggagaggatgctggagctggggtgggaagccctgtacgagcagcgggccgagccacgcagcggcttcgaggagctgaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgt

SEQ ID NO: 461998 - DNA, 977 bp, Homo sapiens
  misc_feature (28)..(28): n is a, c, g, or t
  misc_feature (395)..(395): n is a, c, g, or t
  misc_feature (398)..(399): n is a, c, g, or t
  misc_feature (402)..(403): n is a, c, g, or t
  misc_feature (405)..(405): n is a, c, g, or t
  misc_feature (453)..(453): n is a, c, g, or t
  misc_feature (647)..(647): n is a, c, g, or t
  misc_feature (704)..(704): n is a, c, g, or t
  misc_feature (707)..(707): n is a, c, g, or t
  misc_feature (764)..(765): n is a, c, g, or t
  misc_feature (862)..(863): n is a, c, g, or t
  misc_feature (872)..(873): n is a, c, g, or t
gagacagggtccaggctggagtccagtngcgtgatcacagctcactgcagcctttacctcctgggccaaagtgaatcttcccttctcagcctcccaagtagctggactatggcacacaccacaacacctggctaattttttgaaattttttgtagagatggggatattgctgtattgcccaggctggtctcgaactcctgggctcaagcaatcctcctgccttggctcctcaaagtgctgggattataggtataagccacctctcccagccaaaaccccctcttttatagatgagatatttgctccaagttgcacagctggtttggctcttgactgtagattccagaggcattggtggaacacttgatcatgctggcttcagcatctgcatgttnacnngcnncntaagcttctttggcctctgtgaagcacagactttctgggtctgagtgnatctaagtctcctgctcttctccacagatactatggcgggactgagtttattgatgaactggagaccctctgtcagaagcgagccctgcaggcctataagctggacccacagtgctggggggtcaacgtccagccctactcaggtgcttgtctcatccatatggctggtgcagcctcttcatgtgcatcccccngggccgacatgcaccaagaagagtcctaagatggactgccatggactgccataggcnggncccagtggtactgtaatccagcactttgggaggcggaggaggcagaccacctgaggnnggcagttcaagaccagcctgaccaacatggagaaacccggtctccactaaaaatacaaaaattagctgggtgtagtggcacatgcctgtaatcccanntactcggannctgaggcaggagaattgcttgaacctggaggcggaggttgcagtgagctgccgagatggcgccattgcattccagcctgggcaacaagagcgaaactccatctc

SEQ ID NO: 461999 - DNA, 726 bp, Homo sapiens
cggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctagggtcttgttctcttggccaggctggagtgctgtgggaaaatctgggctcactgcagcctcaacctccgggactcaagtgatcatcctgcctcagccacccagagtagctgagaatacaggcgtgcgccaccaggctcgggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggaactgaatttaatggattaaacttggagaacccttttgtcaaaaaaccgaagcccttgcaaggcccttttaaactctgggacccccacaaattggcctgggggggggttaaaaaccgttctcaaacc

SEQ ID NO: 462000 - DNA, 663 bp, Homo sapiens
tcaatgttgtatccagtgaccttgctaaatttgcttattctaacagttggcccctagcatcttgattttctaggtatattgtgttgtctgtgtgtaatgtcagtttttaaatttcttctttcctaatcgttatgccttttgtttctttttcttgcctcattatacttggaatagaagtagtattagcaggcattttggtcttgttcctgaaggtaaccattttggtttccattgtgtggtcccgtcacatttgtttcattctgcaggtgctttttggttccttctcagcaggtagtgccccagcagcagggctcactacaaccctgggactcctcagggactcctgggtctgtgagccatacttggttgagcaggctgaacacaccagtatccatcctgtctcaccctcaagtcctcatctaggacatcattcctcttgtcatggtgggtggagccagttcaagtgggaggacaggaggcaggtgtggttggaggaagcagcctgaacctgcctccctgacattccacaggtgaacccagatactggctacatcaactatgaccagctggaggagaacgcacgcctcttccacccgaagctgatcatcgcaggaaccagcttgtactcccgaaaccttgtatccccggttcgggattgccctt

SEQ ID NO: 462001 - DNA, 1144 bp, Homo sapiens
cggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggggttgctgtggcactgaagcaagctatgactctggaatttaaagtttatcaacaccaggtggtggccaactgcagggctctgtctgaggccctgacggagctgggctacaaaatagtcacaggt

SEQ ID NO: 462002 - DNA, 1462 bp, Homo sapiens
cttcgggtccgagggccgcggcgtcccagagcccggggggtgcttcggcgtcctcgctgtcccccgccgtaccccaccctctgcagccgcaatgacgggaggggagcgcttgggtcgcgcctgggctggggatcgggcggcggccagccgcagcgccccagttccaggcacattcggtatgatggggtggcggcccgtggcctttggcaagaatgcgaaggcttatcggggatgtgagtagtagctctccactgaacacttttctcgttgagcattttcgatttaaacaatcctagctccttcacaacaaagctgcaagtcaagtgctactgtttcccccattttacaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggtaaaacatcatctgcctctgctcatcctgtagcccctaattcccatcccacctgtcctccaaaatcgtgtgccaggacttccacgctggggaaaaagctggagggctgtctctgtgcaggagatgctaacacagagtagggcatggttgagactggcctaag

SEQ ID NO: 462003 - DNA, 1261 bp, Homo sapiens
cggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggt

SEQ ID NO: 462004 - DNA, 1400 bp, Homo sapiens
cggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctagggtcttgttctcttggccaggctggagtgctgtgggaaaatctgggctcactgcagcctcaacctccgggactcaagtgatcatcctgcctcagccacccagagtagctgagaatacaggcgtgcgccaccaggctcgggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggt

SEQ ID NO: 462005 - DNA, 3384 bp, Homo sapiens
ccgcccagtctccgctgcgagcggttttctgtagacccggaagcggatcgcggggagtgaaggctgcgccgccgagcctgagtttcgctctctctagattaaatctgcgcttcgcagtcccccttcttccatcccccgggtctggaggggtccctacagatcttaaaatgaccacaccgcgccctccaccccagattaacctttaaagactcatgtggcctgaggaagaagtccagaagagaagaaagaggagacagggatggctctttctcaaggaaggttgacattcagggacgtggccatcgaattctctcaggaggagtggaaatgcctggaccctgctcagagggctttgtacagggacgtgatgttggagaactacaggaacctggtctccctgggaatctctctttctgaaatgagtattacctccatgttggggcaagggaaagagccctggactgtggagagtgaagtgaaaataacaaaaacatcaagtggttgggaatgcatcaaaggtgtgaacacagtagtttatcctttcacactcccatggcgctacagctccaacagtgacaaaggcaaagtctttatcatgatggacaacaccctgtcatgtggcttctgtgacctctttgatgtctctcctacacatatgatcaaggaattaccaccaaaagagaacaatagcacaggaaaagtattccaagcagtgatgttggaaagacatgaaatccatgacatccaagatttttacttcagagaaatgcagcaaaatattcatgactttgagtgtcagtgtcacaatgatgagagaaattacagagaaatacctgcaattaaaattaaaaacatcactggaagaagagatcaaggtgatggaaggaatgcaggaaataagccagttgaaaatcagcttgaactaagcttttggttgcatctggctgaactgcagggatttcaaattgaaaggaaaatttatgaatgtaatcaaattgagaagtctgtcacccgtgggtcctcagtttcattacttcaaacaaatcttccttgtgtcaacaccagcatttctaatatatacaggaatgattttatgcatccttcattactcacacaagaccagaaagcatacattagggaaaaaccttacaaatgtagtgattgtggcaaggcctttaatcagaggtccaaccttactacacatcagagaatccatactggacagaaaccacataaatgtgacatatgtggcaaaggtttcaggcgaattgcaaacctagcaagtcatcatagaattcatactggagagaaaccttacagatgtaatgagtgtggcaagaccttcaatcagacgttcaaccttactacacatcagagaatccatactggacagaaaccatataaatgtgatagatgtggcaaaggtttcaggcaaattggaaacctagcaagtcatcatagaattcatactggagagaaaccttacagatgtaacgagtgtggcaagacctttaacaggatgttccaccttactagacatcagagaatccatactggacagaaaccatataaatgtgatatatgtggcaaaggtttcaggcaaattgcaaacctagcaagtcatcatagaattcatactggagagaaaccttacaaatgtagtgattgtggcaagacctttaattacaggtcccaccttacaagacatcagagaatccatactggacagaaaccgtataaatgtgatacatgtggcaaagatttcagtcaaaattcataccttgaaaatcatcagagaattcacactagagagaaatcttacagatgtaatgagtgtggcaagacctttaataagatgaccaaccttactacacatcagagaatccatactggacagaaaacatataaatgtgatatatgtggcaaaggtttcaggcaaattggaaacctagcaagtcatcatagaattcatactggagagaaaccttacagatgtaatgagtgtggcaagaccttcaataggatgttccaccttactagacatcagagaatccatactggacagaaaccatataaatgtgatatatgtggcaaaagtttcagtcaaaattcataccttgaaaatcatcagagaattcacactggagagaaaacttacaagtttctggtggaccatcagagaactcacactggagagaaaccttacaagtgtaatgagtgtggtaaaacctttattgggcattcaagcctaactaaccatcaggtaattcatactggagagaaaccttacaaatgtaatgagtgtggaaaggcttatgtgaagtggtcccaccttagacatcatgagagtattcaaactggagagaagccatacaaatgtaccaaatgcagcaaggcctttagacaatgggcggacatcaggattcaccaaaaaatctatgctggagagaaacctcacaagtatgatgagtgtggaaaaacctttacccaggcctctcacctcactatacatcagattatccatactggagagaaaccatatgaatatgacatatatggcaaagtcttcagtcaaaattcacatttcaaaagttatcataggatttgtactgaagagaagccttacaaatgtgtgtggcaaggtcctcagtcaaaattcacaccttgtaaatcatcagagaattcatactggagagaaatcctacagatgtcatgaatgtggcaaagcctttactcaaggctcacgcttcattaatcatcagatagttcatactggagagaactttccaaatgtactgaatgtagcaaggcttttaagaatggccctaaactcaggactcaccaaatagatcatacttgtaaatgcaatgaatgtagcagtgttttaaagtagtgcttgctactcattagataagagtatctaatatatcttggggcaaaggcacacaaatgcaatgtctgtgacaaggattttatctgaggatcaaaagttggggaacagaataattcgtactggggagaaaccttagaaatccaatgagcatgggaaaaactttaccatgagttcaagtactacaagacatcagagagttcatattgaagagaaaccatgtaaatataaggattcacgtttggctgcaaagatgagtgatatagtttggatctgtgtccctgcccagatttcctgtcaaatggtaatccccagtgttggaggtgggacctgatgggaggtgattggatcatgggggcagattcccctgtggtgccgttcttgtgatggtgagttctcatgagatctggttgtgtaaaagtgtgtggcacctccccctctctctcttccttctgctctggtcatgtgaagtgcctgctcccactttgccttcc

SEQ ID NO: 462006 - DNA, 1949 bp, Homo sapiens
taaatcacagtgagctggcttatgtcaggtcaactgtggaatttgatcctagcgcattgctccctcctcttccttgcctgcgacttggcatcccctaacctgcatcaggaaagggtggcgacagatactctcacacccagggaggctgcaaggcccaccctctaccctccacctgggttctctggcgtcgagacttgtgccctacagttctgggccgttggggtgatgtcccagtgggaccaggaggacaatggagagagagtcaactctgaagtgtggtcttgtggaagaggcagctggcttgttcagtgtggcactggcagcctccctaaggttcccagtgatccaccaatgataactaacatcataaaaagatacatggctggatatgatgttccttctgacggaagaccacaacacctgctgaaaaatcaaatctgaatcggatcaagcctctagaggaggcagcacccagggtcattcctggagcataaacgatccctgcagaacatgggctagaagaccccacagtggggcagaggcaggtcctggactgggatcccagcagtgagaagacctggacatcaaccctatttcattgtgcctctgcaaatctcccaacttttggagctgtagctgcaagctcagacttgtggtttcctgtacctggaggaggcccaggtcattctgttaagtcccttgtctatttcctgcttttatctggatgctgagttaattatttgatccaacaataaaactaacaaggttttatttgtccttaatgtcttctctttgctgaacgctgtgctgggtgctgtagctgacatggtttttgtcttaacagctcatgaatcaaatcccagctccaccttttatagctttagacaagcatttaaccaccacttgggcctgtttccttacctgcaaagtggggataatgacagttaatagctacttcattgtgactttgtgaggattaaataagatacggcagataaactacttaatagggtctggcacattgtaagcctcaataaatggcagctacttcttgtattattattattgtataaaactatgagtgtttaacaatgaatatatagtaaactgtgattctgagtgatgtatgatgtaagatatcctccaggactggtgtcacagggaagtcttgcactagaccttgaaggataagactcagaaactgctagatgccccccattactgactatccccatttcctttaataacaaagctgagactacatttcctagcctcccttgctgctagatatgaccatgtgattaacttctggccgaggaaatggatgcacaagtgttatgtggaactattggaaaggctgcttaaaaggaactggttgagtgggaaagagaatccctttgtcccatttctttctactgctggtctggaatcctgatgtgatggcttgagccccagcatccatgctcgggagtgagttaagggtttcttaataagaccttgcatataaaaatatgcaccagggatgatggagcatgatggaagcctgggtttctgatgacaatgtggagtcactataatgtccctatctccttacttcatgtgggtatgagagaaatgccaagcatcgtgctaggtccaggttgaagatgaaggtgacctgcctcctacctgcaagctgctgaaatgcaacggaaatgaccaaaaaatgtggacagtgatgtgctaagtgctctgatggaaggcaaaagctgcttaggatttcagtcctcatcaggccatcattcccattccagcatctgactctcatgatcctggcccatgggccacataatgacttgtcttttgcaagatcgattttgttctgttatttactaattgcttagttattattttgatggacggaacaaggcacccagccctctgggctcctgtgaaacaaattgacttct

SEQ ID NO: 462007 - DNA, 1093 bp, Homo sapiens
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaaggtgcggggccgcggagggcagggtcgccagagccaggcctcgcggaatgcagggcctgccaggtcctccggggtcgcagatgtccccgggatgggaggagcccggcagctgcagatgacccctggatgggcagagcccggcggccgcagacgtcccgccggccgggtccccagggccgcagacgccccgcagaggccggcgcggcgcccggggctcgccctcgccacacccactgcccggcccggagcccccagggcgccccgctcctggtcgcggggaggggaaaggggtccccgtctgccgtcacccaaaacaatggggtcgctttgtctgctcgggcctctcaagatggccgagttgggtggagacagcgtctccctgggctgagagcgggcgaggccgcatccctgcctccagtgtcacatgagcttttcggtttcgatttgtgtccaagccaagtggccttcgggagggatgtgtcgggggcagacccgcggagctgggggc

SEQ ID NO: 462008 - DNA, 367 bp, Homo sapiens
gctttcgcaggataagtgaccatttttaatcagttcgaaattgctacaaaggaggatcctcgcagcttctacgagcggggtgtcgcagtcttgtgcacagagtaaacttttctagctgcccctgacgcagctgcgctgggtcaagcagacaaacaccgagaagaaggccagtgtggtaaccttacctgtctacctgaacttcacccgtgcagacctcacgggtttgaaacttcaaggggccacgtgcaacaacaagaagctgaatggaatctgacggttgggagtggtggaaattggaaggataccaggaggtatttgggaaggccaatggcgtggctcctttgaggaaataaaacactaagcatga

SEQ ID NO: 462009 - DNA, 353 bp, Homo sapiens
taagttgtttgttttttttttaatttgagacagagtcttgctctgtcgcccaggctggagtgcagtggcacgatctcagctcactgcaacctccacctcccaagttcaagcgattctcctgccccagcctccagagtagctgggacttgtgagacattttaaaggtaatatcctgctttttaaggaatgctagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcac

SEQ ID NO: 462010 - DNA, 15008 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462011 - DNA, 15697 bp, Homo sapiens
  misc_feature (8279)..(8279): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtatgctctcatgtaatcctcaggtgtcctggtaacgaatgaagcacagtaatagcgagctcagttaaaacactagttctcccgaagaaggcatgcatggttgatgcagcatacggccatgtgagctgcaagggaggaggaccctttgtactcaccgggctatttaatggtgctgggttttagggaggccattaagtaacaacctgagtttagaaacaggtggagagctaaaggacacaggagtccaacagagagcagaatgcagttttattgctgctacagctgaaagcagagcaggctctaggtctcagccacgaaggccttacccagagcctgcggctgccagcggaccagatgcatacgacagcgaggctggctccccaggcacaggaggagcttaacagagcacgtttacttccttctcccagatttacccatcagaggccacctctcccattgagtgggagtaagggaagagaagctggggaggctccatgcattttcctttcctctgcaaggacatgcgagtggggattagtgttctcaccccagcagctaggattagctacttatggaagaactgtgcctggagcatttgtcaatgtataatatttgagaagaatgttatgtgagaataaaggaacagagtgtgagtgggtgttttaaatattaaatatttcttccttcaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462012 - DNA, 15506 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaagattatcatcattgatcctcagcctttcctgctgtggaagcagagattaacacacttcaacatgcgctgcatgcaccatgctggccctcggtgaaattcgctctttaaacatctgtaaggccccggaggacttttttcctgggaaaataatacacactgagtagtcactaagtgttgttaattaggatagattgatacaaactggacactttttcagccgttgaatccccccaccagcagctccagacctgtttgctctgctgcctgagggcctcgctccgtaccccagcttctgccccgctgagattctgagtcgtgtgtggtcattagttatatatgatctgggtctcatctcctctgggactgtgaacaacttgggcacgtttctaacccacccaaaaccctgcacataatgtggatgaaccgatttgcaggattcggtataaatcctgaaaggcctcatccctgagcatcttgttcggttttccttttaggtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462013 - DNA, 15147 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccac

SEQ ID NO: 462014 - DNA, 10797 bp, Homo sapiens
  misc_feature (3379)..(3379): n is a, c, g, or t
accttgaggatcccaaacgcagagaggatagcaagcaagagttcttggtccaacgcgagaacctctctgcgtaaatctctcattggggaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462015 - DNA, 15001 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtgcgtcatccgggccgagctcgatgtt

SEQ ID NO: 462016 - DNA, 15025 bp, Homo sapiens
  misc_feature (7590)..(7590): n is a, c, g, or t
  misc_feature (15007)..(15007): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctgatcctcctttgtaggcacgaggcctcgtccagggcagcagagctttgggttctaggtggcttttcagcttgacaagtaatgaagctccatttcaggacttcatcgattccgaaacaagcacagccccccaccccccgccacggaactctactaattattattcacttataatttagctaatttaaaagtacggtaattcagaattgctttgcaactatttttaaaagccctttatttgaaggcccattatttcagaatttgngaaattcacaatttaggt

SEQ ID NO: 462017 - DNA, 14786 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacggacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462018 - DNA, 13340 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttcggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462019 - DNA, 5234 bp, Homo sapiens
cactgatgccgcaggctatctagaggatcccgtctcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462020 - DNA, 3354 bp, Homo sapiens
atgcttatccagagtaggacagcaacatagcatttgggtgaagataaagttacaaagccctgaccatcaagttccacccgtgtggaatgcaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462021 - DNA, 13906 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatccgcgatccgtcgggtaagagcgcg

SEQ ID NO: 462022 - DNA, 13722 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaaggtaagtaccttgtcctcctggtatgctttccccatagaagctaaagcccagtcccatcaccaaatgcagaagtgggtccctgggcccccggaagtgccgtgtggtgaactgcacagctgcttttgcttttcagctgtaggtaaaatttccttccatggccgggcaccgtggctcacactggtaatcctagcactttggaaggtcgaggtgggaggatcacttgagcccaggagttcaagactgtctgggcaggccaggagtggtggctcacgcctgtaatccctgcactttgggaggctgaggtgggcagatcacttgaggtcaggagttcaagaccagcatggccaacatggtgaaactccgtctctact

SEQ ID NO: 462023 - DNA, 1895 bp, Homo sapiens
gtgtggtggatggatggggtcctcgtagatgtcgtagcctgacaggtcagtgaacgactgtgtgcattggccgtcgtcgcataccggcttgcgagtcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462024 - DNA, 1962 bp, Homo sapiens
tgaggccagcaagggccaagtttttggtttgtgtttttttttagcattaagcatgtaagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttcggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462025 - DNA, 11724 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatgagctcgggtgccaaggagaggcatgggaggaatgtgggtggtgatcttgaatttttttcaaaatacacccttgtttgaagagaggaatagaaaatggggcgtgggcatacagtgctggcagcttggt

SEQ ID NO: 462026 - DNA, 11138 bp, Homo sapiens
  misc_feature (7590)..(7590): n is a, c, g, or t
  misc_feature (10055)..(10055): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggtagcaaactcgcatcatttcagacatacttctttttctgccatccctttctaacactaacgaattctaacgaattatcttctactcaaaaatatctttaggctgggtatggtgtctcacacctgtaatcccagcactttgggaggctgaggcaggaggatcacttgatcccaggagtttgagaccagcctgggcaacatagtaagactccacctctacaaaaaaatttgaaaatttagccaggcaaggtaactcacgcctatggtcccagcaacttgggaggcttgagcccaggaagtcacagtgagctgtggtcacaccaccatactgcagcctgggtaaaagagcaaaaccctgtttcaaaaaatacttcagaaaacaaaatatcagccgggcgcggtggctcatgcctgtaatcccagcactttgggaggctgaggcggtggatcacctgaggtcgggagttcgagaccagcctgacctacatggagaaaccccatctctactaaaaatacaaaattagctgggcgtggtgacgcatgtctgtaatcccagctatttaggaggctgaggcaggagnatctttggaacccgggaggcagaagttgcggtgagctgagatcgcgccattgcactgcagcctcagcaacaagagcgaaactctgtctcaaagaaaaaaaaaatacagcgaggtgcaatggcacacgcctgtaatcccagcactttgggaggccaaggcaggcagatcacttgaggtcaggggttcgagaccagcctggacaacatgctgaaactccatctctactaaaaagacaaaaattagccaggcatggtggcatgtgcctgtaatcccagctactcaggagtctgagaatcgcttgaacccgggagacagaggttgcagtgagccaaggtcacgccactgcatctagcctgggcgacagagggagactctgtctcaaaaaaaaaaaaaaattgccaggtatggtggcgtgtgcctatagtcccagctacttgagaggcaggagaatcacttgaacccaggaggcagaggttgcagtgagctgagatcaggccactgcactctagcctgggtgacagagtgagaccctgtctcaaggaaaaaaaaaaaaaaaaaaagatgtatctttgaaactcttaatcacatttctaattgagtttgtgtattgagtgagcagtgggtccgttttcagttctttccttatggacacccattatcccagcaaagtttattaaataataatttactctgcagtatctgtctgtcatcatagtttccctgtgtgcataggtatccgttagttgttctctgtgctaaaaccacatggtcctgattatggtaataagtctgtttaatagggcaggcccaggccaggtgcggtggctcacgcctgtaatcccagcactttgggaggccgagaccggcagatcacaaggtcaagagatcaagaccatcctggccaacgtggtgaaacccgtctgtactaaaaatacaaaaattacctgggcatggtggtacgtgcctgtagtcccagctacttgggaggctgaggcaggagaattgcttgaacccaggaggcggaggttgcagtgagctgagatcgtgccacagcactccagcctggtgacagagcgaggctac

SEQ ID NO: 462027 - DNA, 1187 bp, Homo sapiens
gcgactgtgggactgtggcccaggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462028 - DNA, 975 bp, Homo sapiens
ttcacccttttgaacgattttaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462029 - DNA, 9182 bp, Homo sapiens
  misc_feature (7590)..(7590): n is a, c, g, or t
  misc_feature (9129)..(9129): n is a, c, g, or t
  misc_feature (9137)..(9137): n is a, c, g, or t
  misc_feature (9140)..(9140): n is a, c, g, or t
  misc_feature (9143)..(9143): n is a, c, g, or t
  misc_feature (9164)..(9164): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcgtanataaccanacncgntcatactgtctcctcagtgtnaaacgacaccaccagtca

SEQ ID NO: 462030 - DNA, 9122 bp, Homo sapiens
  misc_feature (7590)..(7590): n is a, c, g, or t
  misc_feature (9069)..(9069): n is a, c, g, or t
  misc_feature (9077)..(9077): n is a, c, g, or t
  misc_feature (9080)..(9080): n is a, c, g, or t
  misc_feature (9083)..(9083): n is a, c, g, or t
  misc_feature (9104)..(9104): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacagatctacggcacctgctaacgcaccatgctgaggcacatttcattccctccgtanataaccanacncgntcatactgtctcctcagtgtnaaacgacaccaccagtca

SEQ ID NO: 462031 - DNA, 8746 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctctacttctctttgctactacatcgtctaccgctgttctgtactcacccc

SEQ ID NO: 462032 - DNA, 6981 bp, Homo sapiens
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaataggttagcgttgtgcaagaggtcatgcgttgtgccacatgaggtctgcggggt

SEQ ID NO: 462033 - DNA, 449 bp, Homo sapiens
  misc_feature (5)..(5): n is a, c, g, or t
  misc_feature (19)..(19): n is a, c, g, or t
atacnactcggcaacggcngccaccggcgctcagctggaatttcccgtgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462034 - DNA, 391 bp, Homo sapiens
ctagaggatccctgtcttacttacccagatgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462035 - DNA, 1339 bp, Homo sapiens
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaaggtgcggggccgcggagggcagggtcgccagagccaggcctcgcggaatgcagggcctgccaggtcctccggggtcgcagatgtccccgggatgggaggagcccggcagctgcagatgacccctggatgggcagagcccggcggccgcagacgtcccgccggccgggtccccagggccgcagacgccccgcagaggccggcgcggcgcccggggctcgccctcgccacacccactgcccggcccggagcccccagggcgccccgctcctggtcgcggggaggggaaaggggtccccgtctgccgtcacccaaaacaatggggtcgctttgtctgctcgggcctctcaagatggccgagttgggtggagacagcgtctccctgggctgagagcgggcgaggccgcatccctgcctccagtgtcacatgagcttttcggtttcgatttgtgtccaagccaagtggccttcgggagggatgtgtcgggggcagacccgcggagctgggggc

SEQ ID NO: 462036 - DNA, 566 bp, Homo sapiens
tgaggccagcaagggccaagtttttggtttgtgtttttttttagcattaagcatgtaagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttctgtaatagataaattcaacagaatcattatttgcatttaaaattctattcagtggtcgggcgaggtggct

SEQ ID NO: 462037 - DNA, 427 bp, Homo sapiens
tctaaaaatcagcaaatggcacctttgtcctatggatacatccaggtagtaaggtgttctcacaggcgtgtacagagggctcacggaaggcacagcagatgtggctgaatttcctgatatgagctgatcctgaaatgctgagcatttgctgagtgggtactttgggaagaacagtccaggcaggggagggcgtctctgagtccatgcttccacacagcacccacccctctgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtaatgtcctggtacagcccggg

SEQ ID NO: 462038 - DNA, 312 bp, Homo sapiens
caaggccaaaattgttttctgaggttaagtcacagagtttcctgaagagtgagaagatgtaactattttctgaaaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtgcgtcacaggcacaaattcctcacgggagtgagctgcagtgaggacccctttccatataa

SEQ ID NO: 462039 - DNA, 629 bp, Homo sapiens
caagaccagcctgaccaacatggagaaaccccgtctctactaaaaataggaaattagctgggcgtggtggtgcatacctgtaatcccagctgctcaggaggctgaggcaggagaatcactagaacctgggaggcagaggttgcagtgagctgagatcgcaccactgcactccagcctaggcgacagagctagactcagtctcaaataaatagtaaatatattcttaatctttatggggataaagaaattaggacttgtgagacattttaaaggtaatatcctgctttttaaggaatgctagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcaccatgctttgctctatcttctcccacccatcgaccctcatccactcctgctgccactcagctgtgaagtcgatcaagaagcagcacctggtggaggtgaggtccatggccaaccctcctgctgctgtgaagctggcgctggagtccatctgcctgctgctgggggaaag

SEQ ID NO: 462040 - DNA, 319 bp, Homo sapiens
ggtcccttgtgcaggtagtgaatgcccacatattgataacatgcatctttctggtttgaattcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtgctgttgctggggaagctttccctccccaccagtggtctcccacgctttcactgtaatgccttttcactgacagttactaggtacctgttttttattgtattttt

SEQ ID NO: 462041 - DNA, 4188 bp, Homo sapiens
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtatgctctcatgtaatcctcaggtgtcctggtaacgaatgaagcacagtaatagcgagctcagttaaaacactagttctcccgaagaaggcatgcatggttgatgcagcatacggccatgtgagctgcaagggaggaggaccctttgtactcaccgggctatttaatggtgctgggttttagggaggccattaagtaacaacctgagtttagaaacaggtggagagctaaaggacacaggagtccaacagagagcagaatgcagttttattgctgctacagctgaaagcagagcaggctctaggtctcagccacgaaggccttacccagagcctgcggctgccagcggaccagatgcatacgacagcgaggctggctccccaggcacaggaggagcttaacagagcacgtttacttccttctcccagatttacccatcagaggccacctctcccattgagtgggagtaagggaagagaagctggggaggctccatgcattttcctttcctctgcaaggacatgcgagtggggattagtgttctcaccccagcagctaggattagctacttatggaagaactgtgcctggagcatttgtcaatgtataatatttgagaagaatgttatgtgagaataaaggaacagagtgtgagtgggtgttttaaatattaaatatttcttccttcaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaagtgagtgcttctgtggcattctatttactaataagtgaaataacaaaactctctc

SEQ ID NO: 462042 - DNA, 575 bp, Homo sapiens
caaagtgcactcttctatatctaccagacgagctacttaagaacagctaaaagagcacacccgtctatgtagcaaaatagtgggaagatttataggtagaggcgacaaacctaccgagcctggtgatagctggatgtccaagatagaatcttagttcaactttaaatttgcccacagaaccctctaaatccccttgtaaatttaactgttagtccaaagaggaacagctctttggacactaggaaaaaaccttgtagatatagaagagtgcacttttgcaaaagtgcactcttctatatctacgagtgcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacaaccagtagtatagaagagtgcactttttaatcctgag

SEQ ID NO: 462043 - DNA, 14746 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462044 - DNA, 15142 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgaaaacacaacacaaaaacaacaaaacaccaccccacatgcatcccacacccaacaacatacacacgaaacaaacaaccaacaaccacaaacagcgccgcccccacccaccacaccgccgccaacacaaaccacca

SEQ ID NO: 462045 - DNA, 10813 bp, Homo sapiens
  misc_feature (3395)..(3395): n is a, c, g, or t
gaggacctcggaaatacacagcggagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462046 - DNA, 15041 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgaaaaaaaaaaaagtcgacgcggccgcgaatttag

SEQ ID NO: 462047 - DNA, 14884 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtgagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462048 - DNA, 14820 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagccgcccctgagttgcagctcgcccctgagttagcagctcgcccctgagttagcagctcgcccctgagttagcagctcgcccctgagttgcagctcgcccctgagttgcagctcgccccctgagttgcagctcgcacctgagttgcagctcgcccctgagttgcagctcgccctgagttacagctcgccctgagttagcagctcgccaaagttgga

SEQ ID NO: 462049 - DNA, 5570 bp, Homo sapiens
gcacatgctgctctccccacagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462050 - DNA, 3235 bp, Homo sapiens
  misc_feature (31)..(31): n is a, c, g, or t
aaaaagattacggctaggtacgaggctgggntgtgggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462051 - DNA, 13685 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcccgacacgttccacttaggcgggatcctctagatcaccgaggc

SEQ ID NO: 462052 - DNA, 2031 bp, Homo sapiens
ggtgacccctgaggttacttatgtctgagtgcttccctgcggagtagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462053 - DNA, 11955 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactctcgagttcccaaccacgattctctgttcctctggacactgttataactttaccatgcgtcc

SEQ ID NO: 462054 - DNA, 11653 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaatagatataggatttgaaggtaagtcaaataggcgaataaaaaagcagaagtataaagcgttgat

SEQ ID NO: 462055 - DNA, 1259 bp, Homo sapiens
  misc_feature (7)..(7): n is a, c, g, or t
  misc_feature (11)..(11): n is a, c, g, or t
  misc_feature (27)..(27): n is a, c, g, or t
ccccccncctnttagtgttggcaggtnactagatcaagagccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462056 - DNA, 9218 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcagcaagtagacgagttcaccccagtatacaaccgcctcc

SEQ ID NO: 462057 - DNA, 9055 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggtcctgcgcacggggatctctaagtcgactgcagcatcag

SEQ ID NO: 462058 - DNA, 8846 bp, Homo sapiens
  misc_feature (7590)..(7590): n is a, c, g, or t
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgtgactaccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaangtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgcccgattataacagtgccctcagtgttccgctgcacgctcatactgttccc

SEQ ID NO: 462059 - DNA, 1669 bp, Homo sapiens
ttcaatgagagaacatttaatgagaggttaaggggcttagaacaacgccgggcacaggctaagcgctcactaaacgttagctctcgccaataacatcactgattcactataaagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacagcaaatcattcagagggaaatctttccctcatgccgaat

SEQ ID NO: 462060 - DNA, 448 bp, Homo sapiens
tggtcactctaagatccacacgtaacgcttcattcacgccttccctgacgcagctgcgtggtagcagacacacgagagaggcagtgtgtagtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatga

SEQ ID NO: 462061 - DNA, 455 bp, Homo sapiens
cagcaacatagcatttgggtgaagataaagttacaaagccctgaccatcaagttccacccgtgtggaatgcaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtaaggaatgggacccttccccagggaaatctggcaggatgtggttttgaaactggattaagacagactgttctgttacctattttggcaggtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaa

SEQ ID NO: 462062 - DNA, 2359 bp, Homo sapiens
atccctagccttagtgccatcccccaggctttttccaggatgggattttatgtgattgtttcgaataggccaccttctctcttctaggcactgtcactgggcttctccccaccccatagatccacagcccccaggtccggtccgccctctaggagaggtgctgtccggtgaggcataaaatcccgggattctggctggaggcagctcctgagactgccggcatgaaggggagccgtgccctcctgctggtggccctcaccctgttctgcatctgccggatggccacaggggaggacaacgatgagtttttcatggacttcctgcaaacactactggtggggaccccagaggagctctatgaggggaccttgggcaagtacaatgtcaacgaagatgccaaggcagcaatgactgaactcaagtcctgcagagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccgcagctcaggctcctgtctctgcccccacagaggggcacacaaatggggacatcaggaacacactcgaggccacagccacacacacagacccacatacagaggatcccactcaaggagcacacgtgcaaaagtccccacagagggacacacaaatggggacatcaggaacacagggccacagccacacacacagacccacatacagaggatcctactcaaggagcacacgtgcgaaagtcccccacagagggacacacaaatggggacatcaggaacacagggccacagccacacacacagacccacatacagaggatcccactcaaggagcacacgtgcgaaagtccccacagaggggcacacaagtggggacatcaggaacacagggccacagccacacacacagacccacacacagaggatcccactcaaggagcacacgtgcgaaagtccccacagaggggcacacaaatggggacatcaggaacacagggccacagccacacacacagacccacatacagaggatcccactcaagaagcacaagtgcgaaagtccccacagaggggcacacaaatggggacatcaggaacacactcggggccacagccacacacacagacccacatacagaggatcccactcaaggagcacacgtgcaaaagtccccacagaggggcacacaagtggggacatcaggaacacagggccacagccacacacacagacccacatacagaggatcccactcaaggaacacacgtgtgaaagtccccacagaggtacacacagggtccacacaggagcaggcacaccacaggcaagacccaaaatggaaatccaggcagacgccacgcaggcaggtggacagagcacagagccagacaacactgcgtgacaggggagagcagtggaaccagaattcaggttacggtcacggtgacagccggaaaggaaattccagcatggatgccgaccgcaccaacccaaaactatgacccgagtcctaacccaccctaacccggccaaaaccgaacacccaaccctgactaaatgcgaaacgctgacccggacctggacctggacctagtacgaacccaagcctgaaccctaacccctaacccctaatcctgatcctagaccctaaccccgaccctaaaccctgaccctgaccctgaagggggacatagaggaaagagattgagaggtttgcatattcaatgacatacattttcttcgttagtcgatgttagaaagcaaaggcttttatctcgagaaatttctgacctaaagaatgatgtacaataaactgtattcaacaattgatcaacattttctaacaaggtggaatgaaaatataaagtgtggggattgctactagtcctaatacactaatctgtggttaggaaggtttatttttttccctccaaacctaagcagtacatgtcttaaattaccttccaaaacgtaagactcttggagcctcagacgggctggcgttagtcaatactccacggctgtttgttggatgagtggacaacagcatggtcgacaggtcctggtgcaaaatgtcttgggctgcctcagtttgaatcctgcttctgccatcgaccagccgtgtgattctgtaaaagtattttaacctctctgggccttagtttccccatctgtaacttgagggcctacctcaaatgggtccctggtgaagagtaacaagactatatcc

SEQ ID NO: 462063 - DNA, 2471 bp, Homo sapiens
gctggcaggagaggcccctctgatggccgacatcaccacctgggctatcatcacccctcagctgtgcagtgggaccctcctgcctgctgacgtggctgctggcgcccgtgccagcgtgaaccccaaacctgtccgtgtttctgcgggcgacgccaccggggacatccctagcttgaccccctttcctggcagtgacactgtcgacatttcctcattctctttccctgtgtctgcccctgtctccacgtggatgccctggataagattcacccgtttaagaaacaccttgcatgccgcctcccgccgcctcgcagtgggcgtgactcgaggtggacgcgcatttacgacaccatcgcccctaggatcggactgcgctgcggagggttctgggaaaggtagtcccacacctcgagtcgactacttccgtttccggtgggcgcgtcaccttgattgcttcttaggcagtggtgaggcgtcttagagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcacgctctggacagtaaaggtggagacaggaacttgtcagagcttggagagtttccggaatgaaaaaggcctggatcttctgcgtctccagcttaggaaaaccagagaataaatacagttgctgctgctcgcagaaaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaattccctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttcaagtccatcagaggctgcacacaggggagaagccctacacctgcagcgagtgtggcaaaggcttctgtgccaagtctgcactgcacaaacaccagcacattcaccctggagaaaagccctacagctgtggcgagtgtggaaagggattcagctgcagctcccacctcagcagtcatcagaagacacacaccggcgagaggccctaccagtgtgacaagtgtggcaaaggtttcagtcacaactcgtaccttcaagctcaccagagagttcacatggggcagcatctgtacaaatgtaacgtgtgtggtaagagtttcagttacagctcagggcttctc

SEQ ID NO: 462064 - DNA, 3489 bp, Homo sapiens
tcacttctcacaatgtcccttgagtacctgaccctatacccgctggttattctaggttatattagcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatcaaatggctactgcagaaggactgataaaacgatctaaagggaaggagagaccctttgttcttacacgttctttctttgctggatcacaaaagtatggtgccgtgtggacaggcgacaacacagcagaatggagcaacttgaaaatttctatcccaatgttactcactctcagcattactgggatctctttttgcggagctgacataggcgggttcattgggaatccagagacagagctgctagtgcgttggtaccaggctggagcctaccagcccttcttccgtggccatgccaccatgaacaccaagcgacgagagccctggctctttggggaggaacacacccgactcatccgagaagccatcagagagcgctatggcctcctgccatattggtattctctgttctaccatgcacacgtggcttcccaacctgtcatgaggcctctgtgggtagagttccctgatgaactaaagacttttgatatggaagatgaatacatgctggggagtgcattattggttcatccagtcacagaaccaaaagccaccacagttgatgtgtttcttccaggatcaaatgaggttcccctgccaagtagaaacctgaggaaaaggttaaatgcaacaactgctgagtaaatgccctgccagatatttttgctgagaatttctcaagttgattccagcaaagtggtgggttcccattaagaggaactggctccctttccgacttagtcacagagttttattcgtgatctatcatcattccaaacacgtcgttgtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggaggtccgcatcatatgacaaagaactgcccctggtgatgtgagcagggacctgcctgcccctttcaacctttcccctcaccttttttgagatttttgctgcaatctgtttgccttccctgaatcaaaataatctttcattcgtcaccattatactaatgaacaatagatttcatgtttcaaaatttcagattttacatgttaagatgtactaacaatattccttgtatcaaacatctccttttctccctgatacatagccctgagacatttatagcgttcaggagtcttctattgcttccattccttcagcagggctgcgtgggtctgttttaacgtgggccaagcctacctgggcagcccatttgccagggcttgcctcaggccatgcagcattggcgctctggctgcagcagctgagttgctcaaggccagtgtccaagtggacagcagcctctggtactccccccagttatcttccacccacatggactgggcagagcagccctcttctgtgtgcactgcatacgctgcagccgtgggagttattctcccctagagatcgacttggcagcacgaaggattcttttctctttcatgcttctcaggctcaatagtttctaattaatcttaaaatccatgtcttttacattgtttttttaattaagtgctgtttactaaccaaataatatttataacatgagtaagctataattaataacaatgaaataaatacccatgtacccaccactggacttcagaagtagaactcatgactgggactaggatgaggcaagggagaccctggccttgggcacaaaatgtaagggatgccaaaaaaatacagtaatcaaagtaagtaatatttcaatccaatatttttaaaaatcagaattaatgcaaaaaaaaccatgatgaacaaaatattaaaatttaaaataaagacaggattagtattactgagttttccttttgtcccaggctctaatatggcttggcatggggcagaacattacaacataccagtcgtgtcatggtgcccaaggctccacagacctcagtggctccctgctgcctgccacagcatctgttttagcagcctcgactcctcagcactcctcagcacacacctcttcttatcaggcttcctccacttagcaacttgctaacggccacctctgtgccttctgatccctgggcgccaatatcctcctgcccttaccatccttccaggcccaacttaaatcccactttcccatgaagcctaactgcgtgaacacccctacccccatacccattagcagtgattttgcccttccccgtaatgctgtcccacttataactgtgctctacttagcattctcagggatcataccttaatgttttcagtatgtctgcgttctcctactagattgtatgtccctcaagagcatgttctgtttctcttctgtctgacagagcactattatacctgactttcagtaactgttagctgtgattagttagctggtggatttaattgattaaaaaattacgattgaatgtatttccatctga

SEQ ID NO: 462065 - DNA, 243 bp, Homo sapiens
tacattcaatcgtaattttttaatcaattaaatccaccagctaactaatcacagctaacagttactgaaagtcagtatgtctgcgttctcctactagattgtatgtccctcaagagcatgttctgtttctcttctgtctgacagagcactattatacctgactttcagtaactgttagctgtgattagttagctggtggatttaattgattaaaaaattacgattgaatgtatttccatctga

SEQ ID NO: 462066 - DNA, 372 bp, Homo sapiens
gaactggctccctttccgacttagtcacagagttttattcgtgatctatcatcattccaaacacgtcgttgtgagtgtgtattatgttccttcagcactatttcctggactgttctgtgattgtttctcttgcttcacaaacctgccgtataaaggatgtggtaatccctggaggtgaacttgcaaaatagactccagggctgccagaaagtgtactgagctagaagaaagaaaaagatgtttgctttcattctgcttctgatgatatcttaagaatttatcccatcaaattactttagagaccttattggtacttcagcaactaaacccccttgatagataacaaccttatctttgaattgtgctttgttt

SEQ ID NO: 462067 - DNA, 324 bp, Homo sapiens
tgtgataccaataaagacaactgtaggaaaatccacaggctggatgactgaatcctcctatggactccgggttgctctaagcactaaggtatttggtaaatctgttactcattttgtttctactctttctttacagtgatagccttttgagtgtgtgacactacgtaaaagtggtgagctcctgacatttatctagaaatcaaggtttgaatcatttctgaatcattgttcagcttgtctgccttccttggaattgttcttaagggaacctttgagatctaggaatgacagaaatgttcctcttgggcactgtgagtgttggtg

SEQ ID NO: 462068 - DNA, 1662 bp, Homo sapiens
tcacttctcacaatgtcccttgagtacctgaccctatacccgctggttattctaggttatattagcacacaagccatgccccctcttttctctttgggataccaccagtgccgctggaactatgaagatgagcaggatgtaaaagcagtggatgcagggtttgatgagcatgacattccttatgatgccatgtggctggacatagagcacactgagggcaagaggtacttcacctgggacaaaaacagattcccaaaccccaagaggatgcaagagctgctcaggagcaaaaagcgtaagcttgtggtcatcagtgatccccacatcaagattgatcctgactactcagtatatgtgaaggccaaagatcagggcttctttgtgaagaatcaggaaggggaagactttgaaggggtgtgttggccaggtctctcctcttacctggatttcaccaatcccaaggtcagagagtggtattcaagtctttttgctttccctgtttatcagggatctacggacatcctcttcctttggaatgacatgaatgagccttctgtctttagagggccagagcaaaccatgcagaagaatgccattcatcatggcaattgggagcacagagagctccacaacatctacggtttttatcatcaaatggctactgcagaaggactgataaaacgatctaaagggaaggagagaccctttgttcttacacgttctttctttgctggatcacaaaagtatggtgccgtgtggacaggcgacaacacagcagaatggagcaacttgaaaatttctatcccaatgttactcactctcagcattactgggatctctttttgcggagctgacataggcgggttcattgggaatccagagacagagctgctagtgcgttggtaccaggctggagcctaccagcccttcttccgtggccatgccaccatgaacaccaagcgacgagagccctggctctttggggaggaacacacccgactcatccgagaagccatcagagagcgctatggcctcctgccatattggtattctctgttctaccatgcacacgtggcttcccaacctgtcatgaggcctctgtgggtagagttccctgatgaactaaagacttttgatatggaagatgaatacatgctggggagtgcattattggttcatccagtcacagaaccaaaagccaccacagttgatgtgtttcttccaggatcaaatgaggtctggtatgactataagacatttgctcattgggaaggagggtgtactgtaaagatcccagtagccttggacactattccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctggtgagaaagcagtccattct

SEQ ID NO: 462069 - DNA, 1744 bp, Homo sapiens
cattatatcattccagggatatcactttggaagcgccttctcagcgcttcgaggttgggctgagccccacgtgcggcattccgtccgcgtcgatggccctatttgtggtgccctgtccttgtcctccaagccgggggccgtttctccttcagagcccgtctcactcagtccctggtttcactggtatcagttctggcttctctctagtcttagaagccagccaccctccctagactgcaccatcccttgatgggagtttgcctttctttgcctctgaggatatttaaatgtggccaggctgggccgaaatacctctgaaggaactgtgcattcgttcataagctttgtagcgtcacaaaactctgaccagtatttttgattgaattctgaatatttctgagcttttgtgtgattccgtggttacggcttccagtgtcattcagtggacgtgttccagcagcaactcacacggactcttaacgtacacgccactcacatgcactcgtaacgtgcacaccactcacagactcgtaacgtgcacgccactcacagactcgtaacgtgcacgccactcacagactcgtaacgtgcacgccactcacacggactcgtaacgtgcacgccactcacagactcgtaacatgcacgccagtcacagactcgtaacgtgcacgccagtcacagactcgtaacgtgcacgccactcacacggactcgtaacgtgcacgccactcacacggactcgtaacgtgcacgccactcacagggactcgtaacgtgcacgccactcacacggactcttaacgtgcacgccactcacagactcgtaacgtacacgccactcacagactcgtaacgtacacgccactcacacagactcgtaacgtacacgccactcacacggactcttaacgtgcacggcactcacagggactcttaacgtacacgccactcacactgactcgtaaggtgcccgccgctcgcactggctcgtaaggtgcccgccgctcacacggactcgtcacatgcacacggcactgtgcgctcggcagtttttactaaacagtgtggcgcaaaaatttgccgtgtcgctatggtctttgggccgaacacgagtggcttccttgggcccaagttggtttctgcttatgcagacagtcacgcggcccaacacggcccgtcccggcacacctcgtcttaggaggagccgttcctcggggaagcccctgagtgctcctcagaagccagccctggggaaggggggagctggggtgcagacggcgggggctgcagcctcggggaaggggggagctggggtgcagacggcgggggctgcagctcgaggtaaggaaggtgtgctacagcagcagacggcaggggctgcagcatggggaagggggttgtgctggggtgcagacggcgggggctgcacctggggagcggggagggctggggtgcagacggcgggggctgcagtcagctgtccgtctcttcgagtctccggtgcggccagcctcaggttccccccggcggcactggccctgcgctcactgtggccgggcgaggacccgtcttgcatcggtggccacagcaagtccgccgtgtggtcactgcactgcctgttccgtgtttgactcccagcagctggggaaggtcttctgtgtctttgggagaccagcagtgagtgattgctccgatgcgccatgaccctgtgctaagttcttatttatttatttatttgttt

SEQ ID NO: 462070 - DNA, 2588 bp, Homo sapiens
gcagggaaaatcatgaatcagtgcctggaaggtgaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatttcctttcaatatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccaagtcatttcaaagacatgaaaaaactcacactgcagagaaaccctatgaatgcaagcaatgtggtaaagccttcagtagttccagttcctttccgtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacatgaaaaatcttacactggagggaaaccctatgagtgtaagcaatgtggcctccagctgcccagaacagctgcagagagtgtggattctgagaagctgcagggccctggaaagcaggagacccacgtgcagcttttgtctctctattgcctgcgccgtgtcctggactgctcacgggagttctgcaggagacgccggaatatctggaagctgaaaaatgcttgtgccctctgtctcttgccttggcacctgggtggcttgctgcccacaaccctgtgtctaaaaatacaaaaatcagctgcgcatggtggtgggtaccagtaatcccagctactccggaggctgaggcaggaggatcgcttgaacccgggagatgaaggttacagtgttatgaaagaccttggcggaggaaaacaaccccaggaagcctcgagaaataaatggaaagaccagaatattgaagatcactacagaaatctaagggtcaggcatggtggctcacacctgtaatcccagcactttgggaagcagaggcagttggatcacttgaacctgggaggcgttctggagatcaggagttcgagaccagcctgaccaaaatggagaaaccctgtctctactaaaaatacaaaacttagccaggcatggtggcctgtgcctgtaatctcagctaatcaggaagctga

SEQ ID NO: 462071 - DNA, 919 bp, Homo sapiens
gaaagagacaattgtctacacgggcagtgtagaacgggcacccggtgagtgctcagggatgaccctcctcagcaggtgcccagaggccaacatcgcccaccccgtagccactgtccccaagtcagcctgcagggaagagagcagctcccctggggctgaggctgagtgcaaatctgctggccctgctctacagcacgcagggtctctgccagtgcaccccatctgctgcttcctgggagtggtggctacttcctcaaaaggagggtggatctgctctcctgtgcactccccctacccccgagggacttgtggagccctggccacatcctcccagggggctgcggaggaggtcgggtcactcttgatcccagttcccagtgaaaactggaggttgccatcacctaaccacacatgcaataaagtcttctgcctgctgcttacagcccccgagaaccttctccgagagaataaaacctttgactgctgctcttcctgagtggattttgtttgtgtcttctgatgaactgtgatgtcccgtctatcattttcccaggctcaaggatccaccaaaagttgacgcctcttttggggaggctctgcagtgccttcttctcaccaggctccccgggaagcttgtgaacttggcttgcaccctaagcagccagagaccagtttcatggaagacttttccacggacccgggagaaggggaaaggatgatgcggagatgattcaagcccattacatttattgtgtactttatttctattattatttcactgtaatatataatgaaataattataccattcaccataatgtagaataagtaggaacactgagcttgttttcctgcaactagatggtcccatctgggggtgatgggagacagtgacagatcatcaggcattagatttcata

SEQ ID NO: 462072 - DNA, 930 bp, Homo sapiens
  misc_feature (1)..(1): n is a, c, g, or t
  misc_feature (6)..(9): n is a, c, g, or t
  misc_feature (11)..(11): n is a, c, g, or t
ngccannnnangcccagcagccccacctgtgcagtggttcagcacagtggtagtgttgagcatggcaggggtagcagtcaacgtgtacgtgccatggctgaccaccctggccatgcaccccggggtccccgaaggccctggggtctccgagcccggcccccgggagctgtgtgcctttgtgagcggggcggccgcccacatgctgcgggccctgcagccccggcgcacccggccccccaagaggcggcccaaccacagaaggtttctgcacaaccagatctgcaggcagttcaccaagattgaggctgccacccagcgcctggccctctccatcctgtcccaggaggcacctccccagagaccctcgctccaaaagccacccccaccgcctccatcccccttcctgggagtggcctgtgctgtggcccccactgaggctccccatgccagcgccagcctgagtctcgctgccctggacacctctaccctcgacctctttgacaacattgcgctcaccccagagtgtgcctcaatgccatgggacccctcctctggttctgatgctcccctgccagcgccgggtctgtcccatcgcgacctgggccagctggacctgaggcaggtcccacatttctgcggccccctgccccttccccagcatgccctgggggaagaggctgatctcgtggctcccgactggggttgggtggactgctgggaggtgcctcgtgcctgggattctcaggggatccccgagggttgggggaccagctccccatgaggccaatcacaacccagcccagaacccaggacaagccagaggcccctccacgacggctctacagccctctccaggagcccccaacctgtccactcccttcctggcagcccctgggaaaataaaccaacccagacccccacttcagacca

SEQ ID NO: 462073 - DNA, 966 bp, Homo sapiens
gcggcgcgggagcctctgcagagaacgcgagagatgaagatgggcagacggattcatttagagctgcggaacaggacgccctctgatgtgaaagaacttgtcctggacaacaaaaacctcaagagcttagaccttttcaattgcgaggtaaccaacctgaacgactaccgagaaaatgtgttcaagctcctcctgcaactcacatatcttgacggctatgaccgggacgacaaggaggcccctaacttggatgctgagggctacgtggagggcctggatgaggaggaggaggatgaggatgaggaggagtatgacgaagatgctcaggtagtggaggacgaggaggaggaggaaggtgaagaggaggacgtgagtggagaggaggaggaggatgaaaaaggttataacgatggagaggttgatgatgaggaagatgaagaagagctccgtgaagaagaaaggggtcagaagcgaaaaggagaacctgaagatgagggagaagatgatgactaagtggaataacctattttgaaaaattcctattgtgatttgactgtttttacccatatcccctcccccgctccaatcctgccccctgaaacttatttttttttctgattgtgaaataaacagccatgttgctcacacaaagcctgtttggtggtctcttcacacggacgtgcatgaaatttggtgctgtgacatggatcgggggacctcccttgggagatcaatcccccgtcctcctgctctttgctccgtgagaaagatccacctacgacctcaggtcctcagacctaccagcccaagaaacatctcaccaatttcaaatccgatcttctcggcttagcagctgaagactgacactgcccgatcgcctcggaagccccctagaccatcacggacgccgagctttgggtaactctcacagtggaaggttaagtccgtcccgttcttaatcaatac

SEQ ID NO: 462074 - DNA, 1144 bp, Homo sapiens
gcggcgcgggagcctctgcagagaacgcgagagatgaagatgggcagacggattcatttagagctgcggaacaggacgccctctgatgtgaaagaacttgtcctggacaacaaaaacctcaagagcttagaccttttcaattgcgaggtaaccaacctgaacgactaccgagaaaatgtgttcaagctcctcctgcaactcacatatcttgacggctatgaccgggacgacaaggaggcccctaacttggatgctgagggctacgtggagggcctggatgaggaggaggaggatgaggatgaggaggagtatgacgaagatgctcaggtagtggaggacgaggaggaggaggaaggtgaagaggaggacgtgagtggagaggaggaggaggatgaaaaaggttataacgatggagaggttgatgatgaggaagatgaagaagagctccgtgaagaagaaaggggtcagaagcgaaaaggagaacctgaagatgagggagaagatgatgactaagtggaataacctattttgaaaaattcctattgtgatttgactgtttttacccatatcccctcccccgctccaatcctgccccctgaaacttatttttttttctgattgtgaaataaacagccatgttgctcacacaaagcctgtttggtggtctcttcacacggacgtgcatgaaatttggtgctgtgacatggatcgggggacctcccttgggagatcaatcccccgtcctcctgctctttgctccgtgagaaagatccacctacgacctcaggtcctcagacctaccagcccaagaaacatctcaccaatttcaaatccgatcttctcggcttagcagctgaagactgacactgcccgatcgcctcggaagccccctagaccatcacggacgccgagctttgggtaactctcacagtggaagaatattttcaatccatggatgtggaactcacagatgtggaggacggactatagatacaaactggttagtgcctcacatgctgaacagaacgaatgcaagataacataacttcatagtatgtgagctcttctcagatagtttattaaaaagacatacatagatgctttccttaatatatttaacaaccccaaggctagtctgtcaaat

SEQ ID NO: 462075 - DNA, 2679 bp, Homo sapiens
cggctgtaaccccacagcgcctagcgcagtgcccggcacatagttggtgctccataaacatttgtcaaatggtggaggaacaacgaccactgtgcccccaggaagtcaatgtcatgaacaccccccacccactgcacaaacaggaaaaagcccctgcccacaagaaccccgtctgctttctgcgcagcccggcggcgcacagcagaactacccgaaaaccttcccctacttttcctctcttctcctcggtgacctggttcctctcccagtaccaaatccaggccctcggcacaaagagggttaggcggctgccccaggaggcctgcccagccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggcccccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaatgcacacgtgtgtcagcctctccttccaccaccgctagccccgccatttcctggtggccgcactcatttcctttcccccccaagacttttctcagtctgggtgtgcacgtgcaggaggatgggcccagatcaccgtgctccacaccccactgctggatgccagggccttgtgcccctcccgcagtgctccaggttatatgtgagagtcctgctccccagctggccaaggactgcccctcttggagcaccagcattctgtgggacatggctctcccctacactgcacctcattttgtcacctggccccgaaacagggctgcttgtgctcaggaaatgaccatattttgcaagaagtcttccatcaccttctggtagtcctcacccatttaatcaaagacacaactttgtcctgggattccccgcatgtctctccaacattatctgcccaaccctgacaatatctccttccttctgcagccacaggaaaggccctgtggatggatgaatgcaagcggggcagaggtagaggccaggagtggagagctgggaagtgggggccagaatgagtgtgttttctaactcgtctcattagtgggagccacaggccccacccagccgcaatgccccactggaaacaggttcttggcattggtcaggagtggtgatggccgagtcgaggcttagaatagaaagacaggtttgggcagagacgagaaaggcccttttggggatgattgtgttgagttggggtgatgggtggtgaaagacctccagaatgagggttataaaacctggatcaaaatcctgcatttgccacggattcactagagcctcagtttgcccatcagtaaaaaggtgtggacttgaggtggaccagacttttccaaaccatttttaaaa

SEQ ID NO: 462076 - DNA, 1251 bp, Homo sapiens
cagctgctgttcctgggagccccagcaggtggcactatgaccctgaccatcctcgcaggccccatccagaatgtgtgggcacaataactttaaggtcaggaatgactacactgatgagaagctagaaggcacaaaggaggagggaggcagaacccagaaggcctccctcctgcgatcagacccaggcaccacctgcttctccagccactgcccaggacaccacttccccctgagagttggcaaatccgtcgttttggttaccacctcatggagattcagcccctctggaaaagtccagacacctcacccccctaacctggatggaccacgcagagccaataggaatacttttctgtggacgtgccatgttggaatcccagatctccctgccctgccagcccctgccagcttcctggggacccaactgaccctgaagaaagcctctgatgggcctagaacagagaaggtgacccaggaccttgcccagcctttctggacaactggaagacagttacgcttcgtcctccacctctccctccaacaaaaggatcttagcaagtgttggagaggtgctgaagtcgtattaggaccaaccagactttttctttgaggatactcagaaggagtgaaggagaatggaacagggggtgtgaataaatgagctttctccatgtgtgattcaaagtggtttaacccatgcctcaccttctagaacacccgtggccctctctagccatgagaagtgtcaccactagccatcaaaatgctcccaaaagtccaacctttgaccaaactacatttcagattttcatttcagattttcttaaattctggagaaaaaagaaaataaagtaaaagaataaatattttggttatgccatgtactctgatttgggattcagaaatatgatttctggccaggtgtggtggctcatgcctgtaatcccagccctttgagaggggaggatctcctgagcccaagagttggagatcagcctgggcagtgtaggaagaagacaccatctctaaaaataataaaaagttaggcaggtgcggtggtgcatgtctgtggtctcagccactcaggaggctgaagtgggaggattgcttgagcccgggaggtcgaggctgcagtaagccgtgtttgtgccattgaactgtagcccaggcgacagagcgagacctcatctcaaaaaaaagaaaggaaatatgatttcccacattaccacacctgctgatgtgcatagcaaa

SEQ ID NO: 462077 - DNA, 1118 bp, Homo sapiens
ccacgcgtcgcccacgcgtccgttcttccccaggtctgcgagcctcgaaggcttctttcagacagcagaccccttagaagcgcaaggctgctttctgacaaagaatcaagtgttcctttcaaccagccaagggactggttttctcgctgaccctttgacagctccagccggtccctccattcgaggtccctgacttcctgcaacagactgagatggccttctgagcttttccagggctgacgaccaccttcttgataccttcccctctctcgttctgaatccgtgcccaccagacggactctggctcttgttgcccagactggggtgcaatggcgcaatcttggctcaccataacctccgcctcctgggttcaagcgattctcctgcgtcagcctcccaaatggggccgtctagttgcaggaaaacaagctcagggctcccactgattctacatgatggttccccgtgagcatcgccgcagcgaccgcccacagcaccagctgctgatggctcacacctcctggggctgcaaggcctgtccctggctctggcagcgagatgacagggctgttgccccggcaggggttgctgtggcagctgccagagtggcccgggccatggatgagggccaggatatggaaagcagaggcagaaatgagcccagaggccacagggcccagctctcaggctcccacggtgaagcccagagggaaacgcactcgcaggtggctgtagaccttggggactccagcctcgttcatttaagctcccacaatgttccaggccctatgcggcttgcaaggggcagagagacacagaatgacagccgacatggcactctattgggggaggtatcacagccaagaaatggaggcctggggatgttaaatgccatggcccaggcagcatccgtcctcatgaagccaccttatcagtgtgtgttcttcatcaactccggtggtgggggagttgtggtggggataagaacctgcgtgtgactgctcttggaaagttggaagttcatctcctgcctcggcccctctccttcgctccacccagcccctctggcctctgccatttctccatcccacccagtgtgctctaaccccagagccttc

SEQ ID NO: 462078 - DNA, 2686 bp, Homo sapiens
gaagcggatctcgcggggctactggcgctctcgggtgagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaagtacacattcctagagtctgaaatttcctctctttctgctgtgataacccaccaataggcgatggacaacttttggtggactctcccatggaagaggtttccttggtgacagaacattcttgaaagagaacattaattaatctgtcacagtatcattctgctacatagaggtgcctcttgaagccactgagtagagtagcctgcatgtcccagtatgctgagagagaatcaggacagccggagggataagtgcttctgaccttctggtttctgtggagtttccagtgtctcccaagggcagtgtgacaacgctggttagatatatgctgatcatcctcttggagccagcagtacaaggtgtaggagtttctcctgggaagagcattctccaagttctcaacctcatatctgcgaacatgttgaccaaactgttgctcataccacattattcatcccatacgtgcagttgtacatttttcttcaatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggcctcgggagcatgatccacgagttgctgccctggagccgcacaattttgtagctttcttggcagaaccaggtactcaaagggttgcgcacagcagggagtagagatgactcttgagttttccctgcctaaggatggatgcatatagctgaggggtgccagctgtctgggtagagcctgccccctgagcaagtggggccccaagctgacctcaccctcaatatgtgcagccttttatagcacagtcatgggtcacctaatgatgaggatgtgtgctgagaaatttgttgatttcatcattgtgctaacgtcatagggtgtacttacacaaagctacatgggatc

SEQ ID NO: 462079 - DNA, 787 bp, Homo sapiens
gttttatatctacagtgtgtggggccatgagatgaatgaatattgttttattatatatatttttttctgcttcatatactttcatgatgttttatatgttttaccagaagatttcttccttgagtatttatgtctgagtattagtttcctcaaaacatatataacctccaaaactttgttaaaggatagtattagttattccttttacttctgtttcctgtaactttatatcaactcttagcttatactttttaaaaatagactttctattttttagcaattttatgttcacagcaaactagatttcctgtatactctgttcccccacacgtgcacagcgtcttcccccattatcaccatcccccatcacagtggtacatttgttaaaattgataaacctacattgacacatcattatcacccaaagtccatagtcgatgttggggttcactctatgtatatgctttgggtttgggcaaatatataatagacatatatcctccataatagtatcttacagaataattacactgccctaaaaaatctgtgctctgtctgttcatctctccctccccccagcacctggcaaccactgatctctttactgtctccatagatttgcctttttcagaatgtcatatagttggaaccatatagtatatggccttttcagattggcttctttcacttaataatatgcatttcaatttctagggctgggcgtggtggctcacgcctgtaatcccagcactttgggaggccgaggccggcggatcacgaggtcagg

SEQ ID NO: 462080 - DNA, 597 bp, Homo sapiens
aaatagctaattttatgttatgtaatttcatctcagtttaaaaaaaataaaattagggatatataagttgcttgcattaactcacataaatcagtgaatatgtacacctcttttctgccattttgtgtgaaaataagaaattttcctgtgtccacttggtgaagtgtgtttttatttcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggtaaccacccttgtacatctttacatttttccttgtgagtctcttgggaggccctgatgtgcttgtctgaatccgatccctgttctaaaaggggagattgaaactttttgattgagagtggaaaggcttcataatgtagcatatagactttaaacttcccctttcttcagaagttctgcgcataatcaggtttgacgagtggtggttccagaatatcagtacttacaaaaccttatggaaaacgttttaaagtgtctggtatc

SEQ ID NO: 462081 - DNA, 571 bp, Homo sapiens
gttttatatctacagtgtgtggggccatgagatgaatgaatattgttttattatatatatttttttctgcttcatatactttcatgatgttttatatgttttaccagaagatttcttccttgagtatttatgtctgagtattagtttcctcaaaacatatataacctccaaaactttgttaaaggatagtattagttattccttttacttctgtttcctgtaactttatatcaactcttagcttatactttttaaaaatagactttctattttttagcaattttatgttcacagcaaactagatttcctgtatactctgttcccccacacgtgcacagcgtcttcccccattatcaccatcccccatcacagtggtacatttgttaaaattgataatgatatgtaggttcgtcagttgttaacaaatgtatctctctgttgggggctattgataatggggaaggctgtgcatgtgtgggagtaggaggtgtatgggacatctctgtaccttctaatcaattttgctatgaacttaaaactgctctaaaaataaagtttaataaaaaaaaaa

SEQ ID NO: 462082 - DNA, 1522 bp, Homo sapiens
gaagcggatctcgcggggctactggcgctctcgggtgagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaagtacacattcctagagtctgaaatttcctctctttctgctgtgataacccaccaataggcgatggacaacttttggtggactctcccatggaagaggtttccttggtgacagaacattcttgaaagagaacattaattaatctgtcacagtatcattctgacctacattgacacatcattatcacccaaagtccatagtcgatgttggggttcactctatgtatatgctttgggtttgggcaaatatataatagacatatatcctccataatagtatcttacagaataattacactgccctaaaaaatctgtgctctgtctgttcatctctccctccccccagcacctggcaaccactgatctctttactgtctccatagatttgcctttttcagaatgtcatatagttggaaccatatagtatatggccttttcagattggcttctttcacttaataatatgcatttcaatttctagggctgggcgtggtggctcacgcctgtaatcccagcactttgggaggccgaggccggcggatcacgaggtcagg

SEQ ID NO: 462083 - DNA, 1561 bp, Homo sapiens
gaagcggatctcgcggggctactggcgctctcggcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggcctcgggagcatgatccacgagttgctgccctggagccgcacaattttgtagctttcttggcagaaccaggtactcaaagggttgcgcacagcagggagtagagatgactcttgagttttccctgcctaaggatggatgcatatagctgaggggtgccagctgtctgggtagagcctgccccctgagcaagtggggccccaagctgacctcaccctcaatatgtgcagccttttatagcacagtcatgggtcacctaatgatgaggatgtgtgctgagaaatttgttgatttcatcattgtgctaacgtcatagggtgtacttacacaaagctacatgggatc

SEQ ID NO: 462084 - DNA, 721 bp, Homo sapiens
atccgacccttttattttactcccgtaccttttatttctctcccttttctagctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaagtacacattcctagagtctgaaatttcctctctttctgctgtgataacccaccaataggcgatggacaacttttggtggactctcccatggaagaggtttccttggtgacagaacattcttgaaagagaacattaattaatctgtcacagtatcattctgctacatagaggtgcctcttgaagccactgagtagagtagcctgcatgtcccagtatgctgagagtctccgtcgaactgggatcctctagatcaccgagctgc

SEQ ID NO: 462085 - DNA, 1003 bp, Homo sapiens
aaatagctaattttatgttatgtaatttcatctcagtttaaaaaaaataaaattagggatatataagttgcttgcattaactcacataaatcagtgaatatgtacacctcttttctgccattttgtgtgaaaataagaaattttcctgtgtccacttggtgaagtgtgtttttatttcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaagtacacattcctagagtctgaaatttcctctctttctgctgtgataacccaccaataggcgatggacaacttttggtggactctcccatggaagaggtttccttggtgacagaacattcttgaaagagaacattaattaatctgtcacagtatcattctgctacatagaggtgcctcttgaagccactgagtagagtagcctgcatgtcccagtatgctgagagtctccgtcgaactgggatcctctagatcaccgagctgc

SEQ ID NO: 462086 - DNA, 827 bp, Homo sapiens
gaagcggatctcgcggggctactggcgctctcgggtgagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggtaaccacccttgtacatctttacatttttccttgtgagtctcttgggaggccctgatgtgcttgtctgaatccgatccctgttctaaaaggggagattgaaactttttgattgagagtggaaaggcttcataatgtagcatatagactttaaacttcccctttcttcagaagttctgcgcataatcaggtttgacgagtggtggttccagaatatcagtacttacaaaaccttatggaaaacgttttaaagtgtctggtatc

SEQ ID NO: 462087 - DNA, 1233 bp, Homo sapiens
gaagcggatctcgcggggctactggcgctctcgggtgagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaagtgggtactggccccgacctttttgctttagcccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgctttctactctatccgggaacttagggagaccttagtcttcctgattccatattcttctaagatttgcctctgaaagttgcttttgaaatacacattccggatgggcgtggtgcctcacgcctataatcccagcactttgggaggccgaggtgggcagatcacctgaggtcgggagttcgagaccagcctgactaacatggaaaaaccccgtctctactaaaaatacaaaaattagccgggtgtgttggcgcatgcctgtaataccagctgctcgggaggctgaggcaggagagttgcttgaacccgagaggcagaggttgtggtgagccgagatcacgccattgcactccagcctgggcaacaagagcaaaactccatctcgaaaaaaaaaaaaagaaaaagaaaagtacacattcctagagtctgaaatttcctctctttctgctgtgataacccaccaataggcgatggacaacttttggtggactctcccatggaagaggtttccttggtgacagaacattcttgaaagagaacattaattaatctgtcacagtatcattctgctacatagaggtgcctcttgaagccactgagtagagtagcctgcatgtcccagtatgctgagagtctccgtcgaactgggatcctctagatcaccgagctgc

SEQ ID NO: 462088 - DNA, 1016 bp, Homo sapiens
gaagcggatctcgcggggctactggcgctctcgggtgagtctccgtctttcgggttcaagcctgcgcctcgcgggccacaggttcccacgctccgctgtcgggttttggggtcgccctgtaggttaaaaccccgaacctgctcattcctctcgcggcgtggccctaagacgttcccagtcccgtcgctccgagagggtctagagatctgcgtccatttcggattaaaatcgttctgaacccacacaatatgacctcggggaggatgcgaggaagatgaactgtgatgatccacttcttcttaatgaatgactgacttacctgagaaagaaactcagaggaagaggaaagaaagaagaggagggaatggctctttctcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatgatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaacaaaaaaaaaaaagaacgaaagaaaaacaatgcagcaaggagaaagaacggagaacacacaagacaaaagagaacacgatacaaaaaagacaacacagaagaaacagagccgagacaacaacagcacaaacacaaacgagggaggcgagacaaactaacacagcaggcggccccctgaggaacaccaccagcagcaaagaaaggcacgccaagagg

SEQ ID NO: 462089 - DNA, 1600 bp, Homo sapiens
aaatagctaattttatgttatgtaatttcatctcagtttaaaaaaaataaaattagggatatataagttgcttgcattaactcacataaatcagtgaatatgtacacctcttttctgccattttgtgtgaaaataagaaattttcctgtgtccacttggtgaagtgtgtttttatttcagggactgtttacattcaaggatgtggccatagaattctctcaagaggagtgggagtgcctggaccctgcccagagggccttgtacagggacgtgatgttggagaactacaggaacctgctttctctcgatgaggataacatccctccagaagatggtaaccacccttgtacatctttacatttttccttatatttctgttggatttacaagcaagggattatcaccaaaggaaaataataaagaggaattataccatctggtgatattagaaagaaaggaaagccatggcatcaacaattttgacctcaaggaagtctgggaaaatatgcctaagtttgacagcctgtgggactatgatgtaaaaaattacaaaggaatgcctttgacctgtaacaaaaatctcactcacagaaaagatcaacaacataataaatcctcaatacatttctctttaaagcagagtgtttctataagagatagtgcacaccagtatttcatccatgacaagccatttataaggaatttgttaaaactgaaaaataacataaggtatgccggaaacaaatacgtgaagtgttttgaaaataaaattggattaagcttacaggcacagctggctgaactacagagatttcaaactggggagaaaatgtatgaatgtaatccagttgagaagtctatcaatagttcctcagtttcaccacttcctccttgtgtcaaaaacatttgtaataaatataggaagattttgaaataccctttattacatacacagtatgggagaacacacattagagaaaaatcatacaagtgtaatgactgtggaaaggcttttagcaaaagttcgaacctcactaatcatcagagaattcactctggacagagaccttacaaatgtaacgagtgtggcaaagcctttaaccagtgttcgaacctcactaggcatcagagagtccatacaggagagaaaccatatcaatgtaatatatgtggcaaggtctgtagtcaaaattcaaatcttgcaagtcatcagaggatgcatactggagagaaaccttacaaatgtaatgaatgtggcctcgggagcatgatccacgagttgctgccctggagccgcacaattttgtagctttcttggcagaaccaggtactcaaagggttgcgcacagcagggagtagagatgactcttgagttttccctgcctaaggatggatgcatatagctgaggggtgccagctgtctgggtagagcctgccccctgagcaagtggggccccaagctgacctcaccctcaatatgtgcagccttttatagcacagtcatgggtcacctaatgatgaggatgtgtgctgagaaatttgttgatttcatcattgtgctaacgtcatagggtgtacttacacaaagctacatgggatc

SEQ ID NO: 462090 - DNA, 2570 bp, Homo sapiens
  misc_feature (3)..(4): n is a, c, g, or t
  misc_feature (11)..(11): n is a, c, g, or t
ctnncctcccngactggttatgcaagagcaggcatgagtgtggtttttgtgggtgcatgcgcggcaggcctggggcctggccgcctgctgcctcacctgcaaggaggggcctcccagaaactcccttccccaatgcccagccgccccaccttgccagacttagctgaccagccagcaaggacgcccgctgcctcccacctgccctcctgccctccttcaccagccaagcccagcctgagccagcacctgcctttatgaccatgttcaagggactgagcaaaggctcccaggggaaggggtcccccaaggactccccagccaaggggtcccccaaaggctcccccagcaagcacagctgaatgccacccaggagctgaccctgctcatctcccacatgcaagccagcgccgaccaggtggagcgggacatcctggagacgcagaagaggctgcagcaggaccggctgaacagtgagcagagccaggccctgcagcaccagcaggagacgggcagcagcctgaaggaggccgaggtgctgctcaaggacctcttcctggacgtggacaaggcccggcggctcaagcacccgcaggctgaggagactgagaaggacatcgagcagctgcacgagcgggtgacccaggagtgtgcggagtactgtgccctgtacgagaagatggtgctgccgccccgacgtgggatccaaggtcgactgggcacacgtgctggagcagaaacagaagctggtctgcgcaggccagtatgggccgggcatggcggagctggaggaacagatcgcggagctcaacatcgtgcagaaggagatcaacgaccaaggagagcagctgcggagcctggtggggccggtggcacagagggcggcgtcgtggcgcgggcagagcctgggcagcctgtacacgcactgcagggctgcacgtggcagctgagcgccctggcggagcagcagcgccgcatcctgcagcaggactggagcgacctcatggccgaccctgcgggcgtgcggcgggaatacgaggtcggctggcagagggccatcctggtcctcaccgccgctccccacccgactcgcccccagcacttcaagcagcacgagctgctgagccaggagcagagcgtaaaccagctggaggaggacggcaagcgcatggtggagctgcggcaccccgcggtggggcccatccaggcccaccaggaggccctgaagatggagtggcagaacttcctgaacctgtgcatctgccaggagacccagctccagcacgtggaggactacagccgggtgagccctcgggcagcggcagggcggcagggcggcagggcgggagctcttgccgcacgtgcagagagagaggaacttccagtgcccgctatggagccacagcccacagcatggggaagtccccatccagaggcagtgctgcagctagaggtagctccagagtcctccgggccctgcaccgatacagccaaagaccagcaaagcgacaagctgccagacctcatgccacctgctgtagccactgggctcagccctggagctgagagcatcgctggagatagacgtggcagagaagaggttgcgagcatggccccagccagcagctcccacgctgcccctagtcctgggcatggagcgagccttggtgtcagagaccagggtgtgcagtctgagctcctctaccttactaaagagaggcctcttttatttaccagagccacagccctgctgcctcaggaccttttcattctgccggtgctggggctgtctatctgcaagctggaggtgttgagagcaggaaaaggaggctgtgaggaagggttcgggcagctcctcctgctctcagaggtggcctcctcctccaggcatggaggtctgtccactactgggcttctgggctatttgcccctgatttgctccctggtacgggctcttcttaacaggcaggcaaggggtgcggggaccaggtgagggcttcaaagggtacagtaccaaatcttccaaactcagcacttgtgccctggggtctccaaactgtcttctgccctagaatttattcatactgttaaattaccagtttatgcaaatgatatgtaaataaagctcaattttttgaaacttcatgcctttttgaactctctaatgttagatggtgtttttgaggctatctgaaaatctctgatagttgtgtcttttgttgtggttgtttgtgtgattgagttaccaccaccaaatcaactgttattggaaacatttcaggtatggcttttagaagacctggacctactcttgcctgttttgaccctccagtttattgtggaaggaagtatcatgtggtttcatgtctccggcagatcaatcactttcctccatccatagcagggaggagtcatggcaccccagagggatgaaatacttctccccaagtatttcttattctgtctcttcctctctctcattccctgctccacatctctttctgtctccttttccagttctctctccctcctcatctcactgcatgccactgttcaggctcctggggctccac

SEQ ID NO: 462091 - DNA, 1325 bp, Homo sapiens
agcaaactgaggcacagagagagcatctgagctgaaccacagtcctagacatccccatgtgcttgtcttttccctgccatgtgccatgaagcctgagagttgccttatctgccaagcaacccaacagcaccaggagaaagagcagccgtggtggccacagactgttgtaacaggctcccaaaccagcaccccacttcgagtcccctccctcaccccacctctgcccaccccagaatggtctttccaaatgactaatctggtgaggtcactgccctgccaagagcctctccatggcttctttgtaaatcaaggttcaagtccagacctcagtgtcttcatctataaaaacgacactgggacaagaaaaagcgagatgcggaaagctgtgtgtggccacccacttgtgaacatcgagaagtcagaggcagaacaacctcggacttgagagccctcatcttcccacaccccaacttcagcaagcctccagtgaccccagacaagtcactcgggcaagtcgcgtaactcctctgagtgttcccttccccatctgaagtggatcctaatagcacctgcttcggagggttgtcatgaggatcagaaaaaacgatgcattttttttttttttttttttttggaagcaaggagttaaaatttaaacacagtgtctcctcttagcaacgcccttgacaacctgcaacaccgacaaagtgtcttcaatccaaactgccttcttttacaaagcttccagctacaaatccaagctgacagctgaatatcaccttcaaaacgacaagtttaagctgggagactgtggtcctggagctgttggtgtgtatctctgctattacttgggaagagaagacttcagaacaaagccaacacaaaggaaaaccgaggcaaggtgcagacagattgctgacaacatcatctgagcccctggtgtggctgggcctgaagcaacatccacctctgttctttccagttacaagaggcaacaaatccccatttctgcctaaaccttaggttgggtttctgtcttttgcaataaaaagtattgtttaatggtatctgaagcctgtctttccaattcactaatgaaagctttcttccttcccagggaaatgtctgggggaaagactggcattaggttgaaagaaatggtgagacttcctgctggctggtcccaattccctcactcctggagatatctttaagaattacagtgccggccgggcgcagtggctcacgcctgtaggtatttcagaaaatattttttagtaccagtgcgagaataatcttcatattttggatgaggtgctcttagt

SEQ ID NO: 462092 - DNA, 966 bp, Homo sapiens
agcaaactgaggcacagagagagcatctgagctgaaccacagtcctagacatccccatgtgcttgtcttttccctgccatgtgccatgaagcctgagagttgccttatctgccaagcaacccaacagcaccaggagaaagagcagccgtggtggccacagactgttgtaacaggctcccaaaccagcaccccacttcgagtcccctccctcaccccacctctgcccaccccagaatggtctttccaaatgactaatctggtgaggtcactgccctgccaagagcctctccatggcttctttgtaaatcaaggttcaagtccagacctcagtgtcttcatctataaaaacgacactgggacaagaaaaagcgagatgcggaaagctgtgtgtggccacccacttgtgaacatcgagaagtcagaggcagaacaacctcggacttgagagccctcatcttcccacaccccaacttcagcaagcctccagtgaccccagacaagtcactcgggcaagtcgcgtaactcctctgagtgttcccttccccatctgaagtggatcctaatagcacctgcttcggagggttgtcatgaggatcagaaaaaacgatgcattttttttttttttttttttttggaagcaaggagttaaaatttaaacacagtgtctcctcttagcaacgcccttgacaacctgcaacaccgacaaagtgtcttcaatccaaactgccttcttttacaaagcttccagctacaaatccaagctgacagctgaatatcaccttcaaaacgacaagtttaagtgagttattatttgtaaaggccttataagagtgtctagcacatagtaagtgctatacaagtatttgaggtttacttttattcacttaatttattataaatataaattcattcaaatgccgtgggaattagcaatgaatgaatcttctttatgctggtgtacttgtc

SEQ ID NO: 462093 - DNA, 2079 bp, Homo sapiens
atgtcccaggtgcaggcgaagttttgttcatgtgttcctggaggatttttcccgtggcaagcgcttctccatcctccagcatctcaggcctggctggccactcagtattccttgtccctggcctcgcagcccacccgggaagccacagtgaccagccaccaggtgtgccatcacggaggaagtccaggttggagaggtggtctccttctgtgagcaggtccacctctccacccactgaggcccctttctgcctgtgacagccccacctcaagggccatgcacagccatcagctccagctgccagcatgctactgccatgccccgagtgtccatctgggccccggttcatgacctgttgtctttctgtatctactttctgcagcccctcactgaggaggcctcctgggtttgtccagtgcctgctattaaagctttgctccaagttcaatgcctcgtgtgatctgccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcgtgagtacactgacagtaaggccacagccaggtgtcttggaggtgcccactcctcagcaagctgcgtggaccacagggtcacacgctgcatcaacagacctggagctgagctcaagctgggatctggggggtgggtggggaggctcacaccaccctgtcctgtgtcctgtctgcagacagaggaactgaaacgcgaggtggctaccaacagcgaactggtccagagcggcaagagcaagatttcggagctctggcgcaccatgcaggccttggagatcgagctgcagtcccagctcagcatgaaagcatccctggagggcaacctggcggagacagagagccgctactgcatgcagctgtcccagatccaggggctgatcggcagtgtggaggagcagctggcccagcttcgctgcgagacggagcagcagaaccagcagtacaagatcctgctggacgtgaagacgcggctggagcaggagatcgccacctaccaccgcctgctagagggcgaggatgcccagctgctttgtcctggctcagtggggctctacttttccttcctcctgccctgaagcctgtggctctggcttgtccacccggagctgggggccctgcagaagccccctctctcccctcagcttctctgcccccctcctcagcccccctaagctgcctcttgccttcccagcctgagttggctggggagcttgtaaaacagccccaccagcaggcttatcctgagcggtgctgatgcgggagttggagcagggctgc

SEQ ID NO: 462094 - DNA, 2672 bp, Homo sapiens
gggggataggctaggtacgaggcgggttatcgacgggcactccgcagggtcgcgcgcaccttcacccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacggtgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgcggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgatgtgagcttctcttcctgccccttcctccctgatgtccactcccttcaccttcctcacgcccgtgcaccctgtcccgcccatttccagccctggcccaagcactgggaagagtccacttaccttgaaaccagcacccctttcccaggccctgccccagaccctctccttccctggagagagtggagcttacctggttgcggggagggtgaaagggtgcctgggagggggctcgcaggcccactgttgtcgttccccccgccacgagaagaagaagaaggtccgtaaatactgggacgtgccacccccaggctttgagcacatcaccccaatgcagtacaaggccatgcaagattccagccactgctcttctccccaccatgaccctgacggtctggctgtgaccccaacgccggtgcccgtggtcgggagccagatgaccagacaagcccggcgcctctacgtgggcaacatcccctttggcatcactgagaatcccgagatcaaagagttgtttccatttctctttaaagtgaaatattgtggggctgagatccctcgtagcaacaaaaagtttgctaccatcgaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctgggattggcgctgtcctaagtgccctccatggacggcagttctacgacacagggattggcgctgtcctaagtgccctccatgcacggcagttctacgacacagggattggcgctgtcctaagtgccctccatggacggcagttctacgacacagggattggcgctgtcctaagtgccctccatggacggcagttctacgacacagggattggcgctgtcctaagtgccctccatggacggcagttctacgacacagggattggcgctgtcctaagtgccctccatgcacggcagactgtccaggttttgggagataacctggtactggaattgaagtcctcctcttctctacccataggagttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggggacggggcgggaggcggccaacctgagataagtaccatgttgaaaattaaa

SEQ ID NO: 462095 - DNA, 1799 bp, Homo sapiens
atccaacagaatctggtccgttatgacacagaagtgaagggcctgctcaagctcacaggcccagtgagagagtgagctgggagctttctaccgtactctgttaccttcctgggtacacataagctctaaaacagaagtgtaactctagaggaaggaacaaaatatgaatccaagagttcaggtctatgttttgcatcattaatatgcaaattacttcatatatttataacataaattctgtgtgtcccagtgatgacagctaataagatactcattactggtccaaaactggaaagaaaatccgttggcccaggtgaagaagtccagtgaatgcgggaccgaggccctctggtggaggaacggaggaagtctccgccccgaaggaggccaggcaggatgaggcaacaccagccactgggtgcgtattcccaattaagcctttgaagcaaatacaagtttttctcaaactgtttccagtttattcctggagagagtttaagattcagaagcaaattcttcctcaatctgggaagcatctgcttgtaaacaaagaagccacagtaaccacagagctgagaaggcctgaagctacaacccattgcaatgaatgcggcacccagaagggtgcccgccccaccacagatcaatcggacagcaagaagaggtgaaacaggcacatcttaaagtgcccaaatgtaaaagcatgattcccaggaaatcctgtcttccaaacatgtttaaatcacataatcataattttattcaactaatcgcttccactgttgccatgagagcagaaaaggaaaaatgttcaagtacacggataatcagaacaaaaaaaagaggaagttaacttgcaagaattctattccaaatgctatgagataacccaatttgagagaggcaaacaaaacccacacgattgctttcatatcttcaaactgttagttaattcttaaaatgttgagatcaattaaacatctaagaaggaactgttgcttaaaactccactcaaaatgaagataagagagccaaggaatctcccaatctccctgttttgagggtttccacaaatccctgacattaggtcatttattccatttcaacacccttgcctgagagagtgcaatgatgtcagaattcattatggtaaactattctcaaaacaaatgttcctgccagcattcactcagcgggcactctggcaagctgtcagaacttggggttcatctcctgcactttacttcacaagcttcctgagctgggtgcatttccttccacttggaatcgttcccaacagctcggctgggaccaaggaggaaagggcctgcaggtccccggagcaccagctgctcgcgtgcacaaggcctaagaatgaaaagtggccagactgctctgacagcccagccagaagagcaactcgcctgcccttcacctgtcccctccactcccctaagctccgagtctctgagaaacaggaagtaagaacagtaaaaaactttctctggggccttgtggtcaccctcctgggaaatgatgtgacatctcctaagagtgctggtgcccctgacgggggcaggggaacagtctccagccacggctttggggtggggcacggacagatgaccgcgtgtctggcaggtgtgaatcctgactgctccatcacacttagcacagtgagcgtgtggagactgttctgagttcatcaagaagggccagatcacactaaaaaatgtgaactcaaaagtgaaccaccaaagctttatgagcccataacacaaagctggagaggaaagctc

SEQ ID NO: 462096 - DNA, 1321 bp, Homo sapiens
aatcctcccactagacactcccgcatggtagctggagcagcaaacaactgcttagggatttgaagccaggtgtcctaacttcctccatgggcgctcagcctggggaacctcagaacacttgctctaggatccagacactgtttaggagggtcaagaccttactcatcaaagccccgcctcccccccaacctccgcctccacccccatcctggaaccctggctgtacacacgtgtatgggtacgcgtttggccacatgcatgacaacaaccttgaacatctcccgtcacagcaggtactggacacaggagagcagctgatggtccccgtggaagtcctggaagtggataacaaggaggccttgtggaagtttctactctcaggagctatggccggggcggtgtctcgcacgggcacggcacctctggacagagccaaggtgtacatgcaggtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcagtgcaagaattacttctgtggaatacaagggtccccgcccttccaggagcgtctccttgctggctccctggctgtggccatctcccagaccctcatcaaccccatggagaacttttttctattctccaccctctccttaatcctctctgcttaatccaccactcctcccatctaacatctaccatactttttacatttcatacataatccaaactatttatctctcatatttattttatactatatctattatatatctcatcatttttttctacatatcattttatttttacaccactttatatattaccatccctattacactatttcacctcatctacattataacctctttttcattaatttctcctctcattatatctaacccacacccatcattttctacattctcatccctcatcaacatcatttatttccatcacaaatcaataccttctatttacaccccatccaacactatctattattttccatctaccctctattatttactactcttccatcatcaaccaattcatcaacaaatcactatttattttcaatcctacaatctatttaactacttttttttaaacaaactactccactcttcttcttttctatctcacccaccactccctctattccttcttcccctccatccacactatccctcccatccactctaatccatctaatctctctatactactcctctcc

SEQ ID NO: 462097 - DNA, 1980 bp, Homo sapiens
cctgtttacgaaggagacgtgaggaaaaaagatagaacactgaggttcagagaggctaaggagctgccggaagtcatacaacgtattatgaccgcagccaaagggcctgacgcctgccttcattcaggccccagcaaagcctggggaagggctggccgagcggacttccaaaactcccaggttgtaagcgggccttgctgcggagagcgggacctgcgggctgcccggacgtcggacgccgtccggcttccatccgacagactggccccagttttatggtgccccgtggccacgaaggacaaaaggaaaggacgcacacagaagcagagtctgtatgacatgaagggtttggcaaagccccctgcaaggtctgtttcccgtcttctgctcctcttcacacacaagcgtgtgtgccacattcacactcctacacccacaactacggatctaacacacagtccccaaacatacactctgccaatgaatcaagacttacctggaaggctatgtcattaaaatcactggaattatattaaaattctaaaataggccagcaactgctggtagtgatgcctctgaagtggactaacggaaaacagcgcgtgacagaggacaacgtcttaaaaaacgctgattcttcaagtaactgtactccttggaatggtcaacccagtcccatctgtccttgattacttaatttgcagtcaccggggagttcaaaatgacttttccacagtgaagatggaagcacacctgggcagcagaacgagtgatgtgggctcagctcacagaccttctcacacagggatgtaacaggcggcagaaagaaggaattctccctccccgcgagaaggcttgggaaggacagtctccatgttccgggagactctggactttaaggaagattccttcctgctctagcttatcttttttagcttttttttaaagtattttttttgctgattaactccactctgccaatagtgtgtcctctcaaaggactccaagttcccacagtgcatatgtatccaattttattgctttgcacttgatatacggctttgtaactgctcaaggcatatttttgtgaacattatgtttctgtctcccatactctactctaagcttcttaacaataaaaatcatgccctgcccctgcttgggatttttaactatgactgcattaaatctataaattaattttaaagaaatgacatctttacaatattttgtatttctagccaggaacagtctgtttctccattaatgcaaagttttggtctccaagcaatcggttctgtgtttttgtttgtaggctcaattttaaaccacattttgtaaaggcacttctcaaaaggcaaagataaaaacactgaagctcttaagagcgcctgtctggctgccaagccattgttctactcaaatgtcgaatgaaaagggagaaacagaatgatgattgtatttgaattgcttccaaggaaaagtaacctccagcaaaactctaggcccactttgctagaaatcctggcacgtcggcaacagaaatggaggcagaaaattgcatctttcagaaagcagagtatcaaacaggaaaagccacaaggagtgaggtgctgtgaggttcccgtggtgcaggatccattttatcctttctacttcttcctgctgaaaatgagattatttaaaacaatttaaaagacaattttccctgcaaggggccttttggaaatgagtcaaagtcaaatcccttgttttacgtaaaattaacgtatgacatttcaaagttaccaaactaaaaaaaaggaaaataaatataaacacattccaaaacttaaaaatgaaggagatttcagacagtccctcctggtaaaatgtgaaattgcaccccagctgcagtagctactgtaaatatccaaggaatcagttttaagtgtttggggatcccagggatccctgcaaagcactcaggattttaacatt

SEQ ID NO: 462098 - DNA, 1160 bp, Homo sapiens
  misc_feature (2)..(2): n is a, c, g, or t
  misc_feature (5)..(5): n is a, c, g, or t
  misc_feature (7)..(9): n is a, c, g, or t
  misc_feature (11)..(11): n is a, c, g, or t
  misc_feature (13)..(13): n is a, c, g, or t
  misc_feature (15)..(15): n is a, c, g, or t
gngtngnnnangncnggggcttctggtgggcactgacctgcaatctctgtccccaggctctcggctgagcaaaatctattcccagtccaccctgtcactgtccactgtggccaacgaggcccacaataacctcggggtgaagaggcccacgtctcgccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggactgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgctgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaagttgaaccttgtccccccctccgaggctggccggggtcccacactccctggctgtgtttttagtctcctgttctttctcaaaccaactcctgtcttcaacccccataatcccctaatgcagcttcagccagggcactcccagcccccagccagggctgtttcgaagctgcctctgaactgatctctcaggctcgaggtgtcccactggcccttcctgtggccttggccacccccgcttgctggattctcctg

SEQ ID NO: 462099 - DNA, 3116 bp, Homo sapiens
ccgccaaccgttttcttcctcatcccgcacccttttcttcccatgtctgccttagtcttcttcccaccctcttctcctctccccatcgccttcttcccaccctcttctcctctccccatcgccttcttcccaccctcttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctcactgtcttctccccgcgccttccccacaaccgttttctcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcttcttgcccacccccttctcgcgctctccaactgcctttcacctagaagcgctccacgcgtgcgcccgcctgtgtccctgcgcctggtgtgtctgtgcgcccagccagccccatgagctgggcccctgagctccgccccaacagccaacaggagacccagaaggtcatgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtcttaagccccacggtttgtagtcatttgttctgttcctagccttaggaaactaacacagcatgctaagggaaaagaagaaaattctgcataaaatgtcattttactttttaaaacaactactgttgacagtaaatgagtattcttccaagattcatatgcagaacatatatgcagcccggaacattttttgggacccatggcataagtgattatgatcgataaaatccaaatattaacctgccaaaagagttattttatcttttgcagtcatttaaaggtaataagcagaggtcatgagccctataaaaattaatctattcatttgttgtcacttgatacttacgatccgttgacatatttaggttttaattctttgtacagattatgcttcatactggctacaggtggatgatgcccacctggctgccgatgacttctgcaccaagtgaggctgggtctctggagctgccccaggggctggacaagctgaccctgcctggagccaacctggagatgcagcctgagaacctcaaggaggacctggtctacctgaagaagaaccatgaggagaaggttctaggtcccagggactccaacccaaggatagagatccaaggtcctgccggggcggtcaggaggtcttacatgccctgtcctgtggcttccttctcagctgagctctgtgctgctctaagctgggggagcctactccctgagaagcaggacacccggaaggtggacaaggatgtcagtgtgaagatggacactgtgcctggagtgaacctgagctgcatcctgaatgagatgcgtgaccaggacaagaaactggtggagaagagctgcaaggatgcccagggctggttcttcagcgtggaacagcccctttcctgtgccccacttgtgaaagtctccataaacccctgtggcccactctgccttccagagagaggggctgaactgcaaggtggccaccaacacagaggccctgcagagcggcaggatggagatgtggagctctacatctctgtgcagaacctgagccgtcccagctcagcaaggacccagctggcccagctgcaggggctcatcagaagcatggaacagcagctgtgcgagctctgctgtgatgcagagcaccaggaccacgagcaccaggtccttctggacgtgaagacgcggctggagcaggagatcgccacctacagccgcttgctagaggttgaggacgcccactgagtgtgtcctggagtctccatgcttagtcacacgttgcagctttttgctccccgaaaatggtgaagtccatctatagtctaacgacagtctctcctgctttaattgggtctatttgttgggtcctctgggacatggaaaaaccacttgctcagcttctccttgtaaattcctggtgagtgcctccaggcctactgctgtgctgtttctttttcttcttcctgctgcactgaacccctgccctttcattcttgggcctgtgctaatttctgtgcattcccaactgtgatttttcaccaatttaggggaacctcctctgccagggcctgcttctccccagcagtgcttgcaggggcctgggctggctggcatccctgggtcgatgggtgctcctctccctgcaggctggccactcagtactccttgtccctggcctcgcagcccacccgggaagccacagtgaccagccaccaggtgtgccatcgtggaggaagtccaggttggagaggtggtcttctgtaagcaggtccatctctccacccactgaggcccctttctgcctgtgacagccccacctcgagggtcatggcacagccatcagctgcagctcccagcatgctactgccacgccccgagtgtccgtctgggcactggtccatgacctgttgtctttctgtatctactttctgcagcccctcactgaggaggcctcctgggtttgtccagtgcctgctattaaagctttgctccaagttcaatgcctcgtgtgatctggtctgttcattggtttggggcagtgtgggctgagggactgggataggtggagagtttattgagtgtttgggtattggcttgtcacctgccaatctgttctgcccactccatccaggcctggggctcct

SEQ ID NO: 462100 - DNA, 456 bp, Homo sapiens
gcattcccaactgtgatttttcaccaatttaggggaacctcctctgccagggcctgcttctccccagcagtgcttgcaggggcctgggctggctggcatccctgggtcgatgggtgctcctctccctgcaggctggccactcagtactccttgtccctggcctcgcagcccacccgggaaggtaagaagctgccctgtcctgctgtgtggaccccaaggcggcggagaggctgaggacccttctgtgtgggagactggggggaccacagactcgggcaggtggggggaagagctcctgcctgatgttccctgtgcctccctcctccatcgcctgcagccacagtgaccagccaccaggtgtgccatcgtggaggaagtccaggttggagaggtggtcttctgtaagcaggtccatctctccacccactgaggcccctttctgcctgtgacagcccc

SEQ ID NO: 462101 - DNA, 3208 bp, Homo sapiens
ccgccaaccgttttcttcctcatcccgcacccttttcttcccatgtctgccttagtcttcttcccaccctcttctcctctccccatcgccttcttcccaccctcttctcctctccccatcgccttcttcccaccctcttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctcactgtcttctccccgcgccttccccacaaccgttttctcccccgttttcttcccctcacaccgttttcttcccatgtcctcccaccgtctcgcagcagcgtctgtcagtcgcaatcttcttcccactttcttctctccccctcccatcgtcttttttccccagcctcttattctccgccatcttcttcccctccccaccttctcgcagcagcgacttcctgccgcgtttttctctccccgcaccctcttctcccctcttccactccccaccgtcttcgcccccgatcgtcttcttgcccacccccttctcgcgctctccaactgcctttcacctagaagcgctccacgcgtgcgcccgcctgtgtccctgcgcctggtgtgtctgtgcgcccagccagccccatgagctgggcccctgagctccgccccaacagccaacaggagacccaggagagtcgctgccagggccatcacggctgccgccgcccccgcccccgccgctacctcagaactgaacagtgttggctgcgggcgaaaggcagaaggtcatgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtcttaagccccacggtttgtagtcatttgttctgttcctagccttaggaaactaacacagcatgctaagggaaaagaagaaaattctgcataaaatgtcattttactttttaaaacaactactgttgacagtaaatgagtattcttccaagattcatatgcagaacatatatgcagcccggaacattttttgggacccatggcataagtgattatgatcgataaaatccaaatattaacctgccaaaagagttattttatcttttgcagtcatttaaaggtaataagcagaggtcatgagccctataaaaattaatctattcatttgttgtcacttgatacttacgatccgttgacatatttaggttttaattctttgtacagattatgcttcatactggctacaggtggatgatgcccacctggctgccgatgacttctgcaccaagtgaggctgggtctctggagctgccccaggggctggacaagctgaccctgcctggagccaacctggagatgcagcctgagaacctcaaggaggacctggtctacctgaagaagaaccatgaggagaaggttctaggtcccagggactccaacccaaggatagagatccaaggtcctgccggggcggtcaggaggtcttacatgccctgtcctgtggcttccttctcagctgagctctgtgctgctctaagctgggggagcctactccctgagaagcaggacacccggaaggtggacaaggatgtcagtgtgaagatggacactgtgcctggagtgaacctgagctgcatcctgaatgagatgcgtgaccaggacaagaaactggtggagaagagctgcaaggatgcccagggctggttcttcagcgtggaacagcccctttcctgtgccccacttgtgaaagtctccataaacccctgtggcccactctgccttccagagagaggggctgaactgcaaggtggccaccaacacagaggccctgcagagcggcaggatggagatgtggagctctacatctctgtgcagaacctgagccgtcccagctcagcaaggacccagctggcccagctgcaggggctcatcagaagcatggaacagcagctgtgcgagctctgctgtgatgcagagcaccaggaccacgagcaccaggtccttctggacgtgaagacgcggctggagcaggagatcgccacctacagccgcttgctagaggttgaggacgcccactgagtgtgtcctggagtctccatgcttagtcacacgttgcagctttttgctccccgaaaatggtgaagtccatctatagtctaacgacagtctctcctgctttaattgggtctatttgttgggtcctctgggacatggaaaaaccacttgctcagcttctccttgtaaattcctggtgagtgcctccaggcctactgctgtgctgtttctttttcttcttcctgctgcactgaacccctgccctttcattcttgggcctgtgctaatttctgtgcattcccaactgtgatttttcaccaatttaggggaacctcctctgccagggcctgcttctccccagcagtgcttgcaggggcctgggctggctggcatccctgggtcgatgggtgctcctctccctgcaggctggccactcagtactccttgtccctggcctcgcagcccacccgggaagccacagtgaccagccaccaggtgtgccatcgtggaggaagtccaggttggagaggtggtcttctgtaagcaggtccatctctccacccactgaggcccctttctgcctgtgacagccccacctcgagggtcatggcacagccatcagctgcagctcccagcatgctactgccacgccccgagtgtccgtctgggcactggtccatgacctgttgtctttctgtatctactttctgcagcccctcactgaggaggcctcctgggtttgtccagtgcctgctattaaagctttgctccaagttcaatgcctcgtgtgatctggtctgttcattggtttggggcagtgtgggctgagggactgggataggtggagagtttattgagtgtttgggtattggcttgtcacctgccaatctgttctgcccactccatccaggcctggggctcct

SEQ ID NO: 462102 - DNA, 2628 bp, Homo sapiens
gctctgtcaactctccatgctattttataataatcaacactaatgaaaagaaagggggctttataacagaggcagaactcattatgttctaaaaaatacacgcatgtttcccatgttgaatagtgtcccgcagaaagtcatgtccagctggaacccaggaatgttaaactatttggaaacagggtctctgcagataacacttggttaagacaaggtcacaatgcattagggtgggctgtaaagccaatggctgtgtcctttcaggaaggtcatgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtcttaagccccacggtttgtagtcatttgttctgttcctagccttaggaaactaacacagcatgctaagggaaaagaagaaaattctgcataaaatgtcattttactttttaaaacaactactgttgacagtaaatgagtattcttccaagattcatatgcagaacatatatgcagcccggaacattttttgggacccatggcataagtgattatgatcgataaaatccaaatattaacctgccaaaagagttattttatcttttgcagtcatttaaaggtaataagcagaggtcatgagccctataaaaattaatctattcatttgttgtcacttgatacttacgatccgttgacatatttaggttttaattctttgtacagattatgcttcatactggctacaggtggatgatgcccacctggctgccgatgacttctgcaccaagtgaggctgggtctctggagctgccccaggggctggacaagctgaccctgcctggagccaacctggagatgcagcctgagaacctcaaggaggacctggtctacctgaagaagaaccatgaggagaaggttctaggtcccagggactccaacccaaggatagagatccaaggtcctgccggggcggtcaggaggtcttacatgccctgtcctgtggcttccttctcagctgagctctgtgctgctctaagctgggggagcctactccctgagaagcaggacacccggaaggtggacaaggatgtcagtgtgaagatggacactgtgcctggagtgaacctgagctgcatcctgaatgagatgcgtgaccaggacaagaaactggtggagaagagctgcaaggatgcccagggctggttcttcagcgtggaacagcccctttcctgtgccccacttgtgaaagtctccataaacccctgtggcccactctgccttccagagagaggggctgaactgcaaggtggccaccaacacagaggccctgcagagcggcaggatggagatgtggagctctacatctctgtgcagaacctgagccgtcccagctcagcaaggacccagctggcccagctgcaggggctcatcagaagcatggaacagcagctgtgcgagctctgctgtgatgcagagcaccaggaccacgagcaccaggtccttctggacgtgaagacgcggctggagcaggagatcgccacctacagccgcttgctagaggttgaggacgcccactgagtgtgtcctggagtctccatgcttagtcacacgttgcagctttttgctccccgaaaatggtgaagtccatctatagtctaacgacagtctctcctgctttaattgggtctatttgttgggtcctctgggacatggaaaaaccacttgctcagcttctccttgtaaattcctggtgagtgcctccaggcctactgctgtgctgtttctttttcttcttcctgctgcactgaacccctgccctttcattcttgggcctgtgctaatttctgtgcattcccaactgtgatttttcaccaatttaggggaacctcctctgccagggcctgcttctccccagcagtgcttgcaggggcctgggctggctggcatccctgggtcgatgggtgctcctctccctgcaggctggccactcagtactccttgtccctggcctcgcagcccacccgggaagccacagtgaccagccaccaggtgtgccatcgtggaggaagtccaggttggagaggtggtcttctgtaagcaggtccatctctccacccactgaggcccctttctgcctgtgacagccccacctcgagggtcatggcacagccatcagctgcagctcccagcatgctactgccacgccccgagtgtccgtctgggcactggtccatgacctgttgtctttctgtatctactttctgcagcccctcactgaggaggcctcctgggtttgtccagtgcctgctattaaagctttgctccaagttcaatgcctcgtgtgatctggtctgttcattggtttggggcagtgtgggctgagggactgggataggtggagagtttattgagtgtttgggtattggcttgtcacctgccaatctgttctgcccactccatccaggcctggggctcct

SEQ ID NO: 462103 - DNA, 636 bp, Homo sapiens
ttctaatagttgctgtttgttgcacagaatggacaaatcatagtttatatagtcatgcagtatttatgagaatgttgactcttacttgggtagataaggtacttaaagaaaatgtaattaatagttgatgttgttaaatcttggctggagagttgtttaagggtgttcataaatgagtaaatgaatgaatgaacaaacacatgaataaaacaagagagggcaaacatgggacaaaggtgatcatatctcattgtcgtaaattctttttatgtagcttcagcatccgtttttaacctaagtttaactttctcattccagaagcaggcttagtcacccttgacacagtttgcagttatccacctcctccaagttcttaatatgttagatccagataactgccttgtacagccacctccaggatactgcctccctaaaaaacagctagatacactgaccccacagcctatgtggaccacacagatatactggcttgctctaaatgcaccagtgagaactctctgcaggaaacctgcttgggaaatgccatagcctgcaatacaggctttccccttcccgctggccctgtgaggcatgcaggatctgtaagtaataaactgcttctgttgtttcatttca

SEQ ID NO: 462104 - DNA, 782 bp, Homo sapiens
aaccagagacagccaagcatgtaccaatgatggcaatgtgttcctcactccccagctttataaatatataattgataaatcagtattgtatgtatttgtattgtatttaaattgtacagtgtgacattttgatatacatatatattgtgaaatgattaccataatcaagcgaattaacatacccatcacctcatgtagttccgtttttccatgtgtgcagtgagaatacttaaggtctactcttttagcaaatttcaagcatgaaatacattattgttaactatagtcaccgtactctgcattgggttaccagaacttactcctaactgcatcttactcctaagtttgcatcctctcactaagatctccagattcctctcactcctgacccctagtaactacctttctagtctctgcttctgtgaggttattccaaaacaaaagccaggttctaggctgttgaggctgagggtaggaagtgtatcaacaggtatacagaatagtcactggtcttgggctaaatggtgacttcaagtgtagtggctgcatagtcaaaaatgaattagatgagtacaaaagtgacgaaatgaaagaatgtcaagaatggaccacaaagacagtgttttatgacctaaagattaagatttatccatttgtgtacaattgtggactatataaaataaaacaagactttgacctcagtggataagaagtatttggatgtactaatcaatatttttggtctgggtcagtggtgggttcatctgtgtttgttgtattta

SEQ ID NO: 462105 - DNA, 456 bp, Homo sapiens
aaatctaggttttttcatcctttttaatatcagccttgtgttccacagaatggaggctccagagtgaaattaatgacactttgtcgatgaagatcttgattgtgacctctgtggaaaatgagccatgaaccaaccaataagcaggcttagtcacccttgacacagtttgcagttatccacctcctccaagttcttaatatgttagatccagataactgccttgtacagccacctccaggatactgcctccctaaaaaacagctagatacactgaccccacagcctatgtggaccacacagatatactggcttgctctaaatgcaccagtgagaactctctgcaggaaacctgcttgggaaatgccatagcctgcaatacaggctttccccttcccgctggccctgtgaggcatgcaggatctgtaagtaataaactgcttctgttgtttcatttca

SEQ ID NO: 462106 - DNA, 400 bp, Homo sapiens
cttcattctgcagctgaggctcactgcccccagtgggcagtgggtccagggggtttctgaggacagggcatgacccagccctgctgcccccaagatggcacctggcttggaggggtgaggggccctgttagtctgactttgaagaagaccagccttccagactcgcttggtgccctgacaggagccctgggtcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaaggtaagtatggctacacatttagggg

SEQ ID NO: 462107 - DNA, 2393 bp, Homo sapiens
  misc_feature (1798)..(1798): n is a, c, g, or t
  misc_feature (1905)..(1905): n is a, c, g, or t
agatgggctctgactgtcaacatgaccttcctctcccaggtcctcagtttccccatgtctgcagggagggtttcggtggtggtcttctcactgtgctcctgtagctctggggttcctaagaggtgcctgcgggggtccctgggaaacagtaatgagaggaggtggctggcccaacaggtggagctcagggacacccattgctgccttagttccaccagctgctcctataaattgggaagaggaatccgaggccttgggacctacacccaccctcacacccgggcccacgctcactttaataacccggactgggcaaggactaagtccagccagagcgtcagcctcgctggcgtcctcactggccatggccctgcagccttgctcttcagttcctggaagcctcctgcccttggtggacaaccattttgctctctagcaaatggatagaaaagtttattgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgttcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggtcccccagtgttgcctgggtctgactttgcctcagtgaaaactgcctcgaattctttcttgcaccgatgggcagatgggcagtgtcggaggatcgtgtcatctgtcccgtggcgctgggtaagtctgcagtgttgtaaagctgcaaacacccttctgggtgggngctcaggctggcacccccccactgccccagcctgcgctataccacgttcccctgatgcttgccttgtgccgggccccagaacccagtgtcatggggttcacagcgcngggagtagcgtctcagtgttgtgagttcctggggatgaaggttcggggtaatgaattacagctttggaaatggcctgatttcccattatggctccctccttgcccagaggtaaaacgggtctggtccccagaacaggaggaggacatgtgatgactggagtaacgatgaggggctctggggaaggacagggctgagagcaagtgctgggacctttgggaccgagtcatattctaaaaagagcacaggctttgggggagaggagctgtgaggccaaggcagcattcccctggggagcttgtcaggagtaacaggagccactggcagtgtttgggcttttggtccctttttttctctcccaggggaagggagaaggaggcattgcaggaagccagccaccctgagcacagacccagctacagaacagacttgagctgcgtgtccttggcaaatccccaagtgtttctgtgccttggtttcctgatattaa

SEQ ID NO: 462108 - DNA, 2405 bp, Homo sapiens
agatgggctctgactgtcaacatgaccttcctctcccaggtcctcagtttccccatgtctgcagggagggtttcggtggtggtcttctcactgtgctcctgtagctctggggttcctaagaggtgcctgcgggggtccctgggaaacagtaatgagaggaggtggctggcccaacaggtggagctcagggacacccattgctgccttagttccaccagctgctcctataaattgggaagaggaatccgaggccttgggacctacacccaccctcacacccgggcccacgctcactttaataacccggactgggcaaggactaagtccagccagagcgtcagcctcgctggcgtcctcactggccatggccctgcagccttgctcttcagttcctggaagcctcctgcccttggtggacaaccattttgctctctagcaaatggatagaaaagtttattgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgttcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggtcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatgataagtctacttttcttccacgtaacaaccacaggatagatgacattcattttctaagaaacaaaatcttggcagttagatccgtggggtaaagaatatagatactaatgtaagttaacacctcaagttcatgtccttggtttggatgctttgttcaggagtgtttagtggtatttcaaaggaatcaatatctataacaaattaaaataaccaggaatggaccagtg

SEQ ID NO: 462109 - DNA, 1250 bp, Homo sapiens
ccaccatctatgtagcattccaatattcttgattgactcataaatttcttttacagttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatatgaaaaataaaagaaatctacatggatcccactttggacaaagtgcgtgtcaacagttgcatgaaatggtatttcacttcttgattattgtttgtttttattctttttttagaaaaaatgaataaatgatcaaattattttgggggtaattaaataaaagaaagaacacaagtgagtcagtaaatgcttaaattaaggtagatcttggatcattgcttcatggcacactctcagaaatgctcaaatatggtgccttaaaaaaattaatgaggtttgggtgttgatgtggttagggagtatacagatagatagttgttagtggttacatttattactcttgcattgggtggatttaagggttcattatattaagaattaaacagtaagtaaattcatacataaaaggtatggttattcttgagtcaataatgagaatgtgttaggaaccaaggtttatgattaatctaaaataatttctaaaagaagttaagtctttgctgtttcgttctttctaaaatgtgtattttccttcacacaatgaacatgccacagctaattattcgataacaataaagacattggtgttttgcctctgtggttaaggagctcagagtctgttgtagataatagttaaagttcatgtcctgggtttaggtggcttgttcatcactaaattatgttagaagaataaaccgctaaatatatacatatataaaaagcataccatacaagaaccaataatggaagtgaaccaaggtttatgattag

SEQ ID NO: 462110 - DNA, 184 bp, Homo sapiens
gcccccaagatggcacctggcttggaggggtgaggggccctgttagtctgactttgaagaagaccagccttccagactcgcttggtgccctgacaggtatgtgtgctcttctctctcccacctaacagccccttttgggagacagggtctgagaggagtcagggtcgtataaccttaacacagt

SEQ ID NO: 462111 - DNA, 2946 bp, Homo sapiens
agatgggctctgactgtcaacatgaccttcctctcccaggtcctcagtttccccatgtctgcagggagggtttcggtggtggtcttctcactgtgctcctgtagctctggggttcctaagaggtgcctgcgggggtccctgggaaacagtaatgagaggaggtggctggcccaacaggtggagctcagggacacccattgctgccttagttccaccagctgctcctataaattgggaagaggaatccgaggccttgggacctacacccaccctcacacccgggcccacgctcactttaataacccggactgggcaaggactaagtccagccagagcgtcagcctcgctggcgtcctcactggccatggccctgcagccttgctcttcagttcctggaagcctcctgcccttggtggacaaccattttgctctctagcaaatggatagaaaagtttattgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgttcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggtcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaatatgaaaaataaaagaaatctacatggatcccactttggacaaagtgcgtgtcaacagttgcatgaaatggtatttcacttcttgattattgtttgtttttattctttttttagaaaaaatgaataaatgatcaaattattttgggggtaattaaataaaagaaagaacacaagtgagtcagtaaatgcttaaattaaggtagatcttggatcattgcttcatggcacactctcagaaatgctcaaatatggtgccttaaaaaaattaatgaggtttgggtgttgatgtggttagggagtatacagatagatagttgttagtggttacatttattactcttgcattgggtggatttaagggttcattatattaagaattaaacagtaagtaaattcatacataaaaggtatggttattcttgagtcaataatgagaatgtgttaggaaccaaggtttatgattaatctaaaataatttctaaaagaagttaagtctttgctgtttcgttctttctaaaatgtgtattttccttcacacaatgaacatgccacagctaattattcgataacaataaagacattggtgttttgcctctgtggttaaggagctcagagtctgttgtagataatagttaaagttcatgtcctgggtttaggtggcttgttcatcactaaattatgttagaagaataaaccgctaaatatatacatatataaaaagcataccatacaagaaccaataatggaagtgaaccaaggtttatgattag

SEQ ID NO: 462112 - DNA, 2495 bp, Homo sapiens
agatgggctctgactgtcaacatgaccttcctctcccaggtcctcagtttccccatgtctgcagggagggtttcggtggtggtcttctcactgtgctcctgtagctctggggttcctaagaggtgcctgcgggggtccctgggaaacagtaatgagaggaggtggctggcccaacaggtggagctcagggacacccattgctgccttagttccaccagctgctcctataaattgggaagaggaatccgaggccttgggacctacacccaccctcacacccgggcccacgctcactttaataacccggactgggcaaggactaagtccagccagagcgtcagcctcgctggcgtcctcactggccatggccctgcagccttgctcttcagttcctggaagcctcctgcccttggtggacaaccattttgctctctagcaaatggatagaaaagtttattgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgttcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggtcccccagtgttgcctgggtctgactttgcctcagtgaaaactgcctcgaattctttcttgcaccgatgggcagatgggcagtgtcggaggatcgtgtcatctgtcccgtggcgctggttggcttggtcaagtcagtgttcaaactatctcctgctctttcaaggggatctggggctctagaagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggactgttgtgagaatcaaacgagataatgtatgctgaggcatgctgtgaacactacgtgctgggtacaggagaatggaggctccagagtgaaattaatgacactttgtcgatgaagatcttgattgtgacctctgtggaaaatgagccatgaaccaaccaataagcaggcttagtcacccttgacacagtttgcagttatccacctcctccaagttcttaatatgttagatccagataactgccttgtacagccacctccaggatactgcctccctaaaaaacagctagatacactgaccccacagcctatgtggaccacacagatatactggcttgctctaaatgcaccagtgagaactctctgcaggaaacctgcttgggaaatgccatagcctgcaatacaggctttccccttcccgctggccctgtgaggcatgcaggatctgtaagtaataaactgcttctgttgtttcatttca

SEQ ID NO: 462113 - DNA, 2275 bp, Homo sapiens
acaaaagtcccttcagttcagccggctgcaggggaagtcccggcgcccgcgaaaccaccctcccgtgcagccgagcccagccgctctccggccgccgtcccccgccactggccccgtatgccccgcgggcgcatgtgacgaggggcccgtggactgcgcacccggcccaaggccactggactcccgggcgccgcgctgccgctccgcaagcgcccgctgcgccgcccttccccggagcccgccgctccccgcgggcgctgcgggccttgtcgtccccctggaccctctgcgcggcggctgcgacctgccggcggtccccgggcccccccacggcctggcccgccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgccggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccatatcccttgggtgcatgggcctctttcatgagatggacctggcggaagtgccttcgtgtgtgtgcacacccgtgcactgaatccagttgactcccagagtgatgttggcaccctgttggattccgtagtgaccctgggcatgtgtgtttctgtagtgtgggggtcctggtgataacccacagctgacttcagccccaatcgtctctggctgtccgagtgcgtggtgcttgggagtgttcctaacattgagatctggggtgatgctgtgattgttgccctgtgactgcctcacatggcgtgagacagttttacttagtggttccatggggcccctctaatggaccacatctgtggttttgttgttgttttttttgggg

SEQ ID NO: 462114 - DNA, 1900 bp, Homo sapiens
acaaaagtcccttcagttcagccggctgcaggggaagtcccggcgcccgcgaaaccaccctcccgtgcagccgagcccagccgctctccggccgccgtcccccgccactggccccgtatgccccgcgggcgcatgtgacgaggggcccgtggactgcgcacccggcccaaggccactggactcccgggcgccgcgctgccgctccgcaagcgcccgctgcgccgcccttccccggagcccgccgctccccgcgggcgctgcgggccttgtcgtccccctggaccctctgcgcggcggctgcgacctgccggcggtccccgggcccccccacggcctggcccgccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgccggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccata

SEQ ID NO: 462115 - DNA, 1460 bp, Homo sapiens
acaaaagtcccttcagttcagccggctgcaggggaagtcccggcgcccgcgaaaccaccctcccgtgcagccgagcccagccgctctccggccgccgtcccccgccactggccccgtatgccccgcgggcgcatgtgacgaggggcccgtggactgcgcacccggcccaaggccactggactcccgggcgccgcgctgccgctccgcaagcgcccgctgcgccgcccttccccggagcccgccgctccccgcgggcgctgcgggccttgtcgtccccctggaccctctgcgcggcggctgcgacctgccggcggtccccgggcccccccacggcctggcccgccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgccggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcacaatgccacacagcccccgtgatgtctctgactttatttgctgtgaccccgacccactgttcacatcccttcagtcatgtgggccttgcttcccattccctgaatgtgccaggcatgctccacctcatgcctctgcacctgcagttctctctcactga

SEQ ID NO: 462116 - DNA, 2887 bp, Homo sapiens
tgtacgacaaaactgcagctctgggaagtcagctggccaggtcccgctgctgaactgtactaagtgctgatgtgccagcgctatgatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggaactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcactgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacatacacatacacaatctgctccaaggagtgttctgc

SEQ ID NO: 462117 - DNA, 3193 bp, Homo sapiens
tgtacgacaaaactgcagctctgggaagtcagctggccaggtcccgctgctgaactgtactaagtgctgatgtgccagcgctatgatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggaactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcactgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacatacacatacacaatctgctccaaggagtgttctgc

SEQ ID NO: 462118 - DNA, 3409 bp, Homo sapiens
  misc_feature (3)..(4): n is a, c, g, or t
  misc_feature (7)..(9): n is a, c, g, or t
ccnntgnnncagatgaagtctccatgagctacagggcctggtgcatccagggtgatctagtaattgcagaacagcaagtactagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgtccctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggacatccctccactcttgggagacacagagaagggctggttccagctggagctgggaggggcaattgagggaggaggaaggagaagggggaaggaaaacaggtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctgtacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtggggtccagcccacaacagtgtttttgcctggcccgtagtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatccatctgcactatgcgggcgaggccggcgccatgacgtcatgtagctgcgactatccctgcagcgcgcctctcccgtcacgtcccaaccatggagctgtggacgtgcgtcccctggtggatgtggcctgcgtggtgccaggccggggcctggtgtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgcttcgcctgtcagagcctgccaagatcacagatgttgtgaaggtcctgggcctgccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattactggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggaca

SEQ ID NO: 462119 - DNA, 3372 bp, Homo sapiens
  misc_feature (3)..(4): n is a, c, g, or t
  misc_feature (7)..(9): n is a, c, g, or t
ccnntgnnncagatgaagtctccatgagctacagggcctggtgcatccagggtgatctagtaattgcagaacagcaagtactagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgtccctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggacatccctccactcttgggagacacagagaagggctggttccagctggagctgggaggggcaattgagggaggaggaaggagaagggggaaggaaaacaggtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctgtacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtggggtccagcccacaacagtgtttttgcctggcccgtagtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatccatctgcactatgcgggcgaggccggcgccatgacgtcatgtagctgcgactatccctgcagcgcgcctctcccgtcacgtcccaaccatggagctgtggacgtgcgtcccctggtggatgtggcctgcgtggtgccaggccggggcctggtgtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgcttcgcctgtcagagcctgccaagatcacagatgttgtgaaggtcctgggcctgccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattactggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggaca

SEQ ID NO: 462120 - DNA, 411 bp, Homo sapiens
aggccaagactggagccttgttccctctgttggactccctgcccatattcttgtgggagtgggttctggagacatttctgtctgttcctgagagctgggaattgctctcagtcatctgcctgcgcggttctgagagatggagttgcctaggcagttattggggccaatctttctcactgtgtctctcctcctttacccttagggtgattctgggggtccacttgtctgtaatggtgtgcttcaaggtatcacatcatggggccctgagccatgtgccctgcctgaaaagcctgctgtgtacaccaaggtggtgcattactggaagtggatcaaggacaccatcgcagccaacccctgagtgcccctgtcccacccctacctctagtaaatttaagtccacctcacgttctg

SEQ ID NO: 462121 - DNA, 3212 bp, Homo sapiens
  misc_feature (3)..(4): n is a, c, g, or t
  misc_feature (7)..(9): n is a, c, g, or t
ccnntgnnncagatgaagtctccatgagctacagggcctggtgcatccagggtgatctagtaattgcagaacagcaagtactagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgtccctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggacatccctccactcttgggagacacagagaagggctggttccagctggagctgggaggggcaattgagggaggaggaaggagaagggggaaggaaaacaggtttctgtatctgcccttcaccctctcacactgctgtttcccaactcgttgtctgtatttttggcctgaactgtgtcttccccaaccctgtgtttttctcactgtttctttttctcttttggagcctcctccttgctcctctgtcccttctctctttccttatcatcctcgctcctcattcctgcgtctgcttcctccccagcaaaagcgtgatcttgctgggtcggcacagcctgtttcatcctgaagacacaggccaggtatttcaggtcagccacagcttcccacacccgctgtacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtggggtccagcccacaacagtgtttttgcctggcccgtagtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatccatctgcactatgcgggcgaggccggcgccatgacgtcatgtagctgcgactatccctgcagcgcgcctctcccgtcacgtcccaaccatggagctgtggacgtgcgtcccctggtggatgtggcctgcgtggtgccaggccggggcctggtgtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgcttcgcctgtcagagcctgccaagatcacagatgttgtgaaggtcctgggcctgccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattactggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggaca

SEQ ID NO: 462122 - DNA, 815 bp, Homo sapiens
ctatgttccaataacattttatttacagacaacttctgggttggtgagcagatcgaggtaccaggaaggtggtgcgtgccctgccccccaccccaacacttgaccccacgcatcctcatgcagctcttccgtttggctgttcctaagtcgtatcttttgtaataaaccagtaaaagaaaaaaaaccaccaaaaagccacatctttatttacaaaagcaaacgcaggctgggtttggcccatggactgtagtttgctgactcctgaatatcatatatgaccctcttggccagccatgggctcctaggcaaaactctgaagaaaacaggaagggaggaagggagggagggaggaagggagggaggaagggaggggaaggaaaggaaggaaggaaaggaaataaggaaagaaaaaaagaaagagagaaagaaaaagaaaggaaagaaggaaaggaaaggaagagaagaaaggaagaaaggaaaagaaaagcaaggaaggaaagaaagagaaaaagaagcagcagaagaaaagaaaaagaaaaagagaaggaggggctgacatcctacccctaggcggaacttcactttgccgaaacacaggtggcattctgctacacaaggcttgtcagatggaacagcacgctggagggggttgtgcaagaggctcactgggacatgggccacaactctaagaggtgagggactctggctttagtcaccagagaaaaatccagtactttctggaacactcaccagccttaccctgcaaagataggaaagcacagggaaggcggaagactgtgtttcattcaaactgt

SEQ ID NO: 462123 - DNA, 1769 bp, Homo sapiens
cctgctgtgacaacacagcccttgtcccacgcagcctaagtgcagggagcatgatgaagtcaggcagccagtcggcacccatgccagccccctacgtcctccgaagacccgagggccaggccagtgtccctcatctacaaggtccagggtccatggagaactccttgtctggctgtcttgagacagcagcccgggccctgtccggcccccggaaggcagggctgcgctcctccaggatgcctgaggtgcagctggagagggagctgctgtcccgtgtggggaggggccgccacggcgtacgggggagcctgggtgatggtgccagcggcgccctcatcgccatggtaaccaccctccccctcctcggggtcccactcctccttgtccatgatgctgaggacgtcacccagcatggagggccccaggtcgatgtgggacatggcattcttgacaaacagggccgagtccgcagggagcccagcatgtcacgctgctcccgctcccccctggtcaccgactgtgaccgcttgctgccccggaacttcctggacaggagactgcgtttggaagatgaagaagagggctgttcgtccaaggactcgccgtcgggctcgccagccttgctattgaggaaggaggtgtccccaaaggcgtctccggcccggccaacgtgcatggtgtggcggaagtcgcccagcggggcgctgatcatctcggccgtgaggtccgctcgggaacggcgcttggagtgcaccgagctggacaccagttgcttgaggattggcatcttgctggatgggcggggaggcattcagagtagaggagtgattttgcaaatctggttagagttccagtagcctcggacacactttccctgaaacttgagagagacagaacctttcttgcagaagacaatgcctcccctgcccctgcaagccaggatgctgccagagtaaacatgaccacatttaaggacgcgaagacaacttctgggttggtgagcagatcgaggtaccaggaaggtggtgcgtgccctgccccccaccccaacacttgaccccacgcatcctcatgcagctcttccgtttggctgttcctaagtcgtatcttttgtaataaaccagtaaaagaaaaaaaaccaccaaaaagccacatctttatttacaaaagcaaacgcaggctgggtttggcccatggactgtagtttgctgactcctgaatatcatatatgaccctcttggccagccatgggctcctaggcaaaactctgaagaaaacaggaagggaggaagggagggagggaggaagggagggaggaagggaggggaaggaaaggaaggaaggaaaggaaataaggaaagaaaaaaagaaagagagaaagaaaaagaaaggaaagaaggaaaggaaaggaagagaagaaaggaagaaaggaaaagaaaagcaaggaaggaaagaaagagaaaaagaagcagcagaagaaaagaaaaagaaaaagagaaggaggggctgacatcctacccctaggcggaacttcactttgccgaaacacaggtggcattctgctacacaaggcttgtcagatggaacagcacgctggagggggttgtgcaagaggctcactgggacatgggccacaactctaagaggtgagggactctggctttagtcaccagagaaaaatccagtactttctggaacactcaccagccttaccctgcaaagataggaaagcacagggaaggcggaagactgtgtttcattcaaactgt

SEQ ID NO: 462124 - DNA, 1856 bp, Homo sapiens
cctgctgtgacaacacagcccttgtcccacgcagcctaagtgcagggagcatgatgaagtcaggcagccagtcggcacccatgccagccccctacgtcctccgaagacccgagggccaggccagtgtccctcatctacaaggtccagggtccatggagaactccttgtctggctgtcttgagacagcagcccgggccctgtccggcccccggaaggcagggctgcgctcctccaggatgcctgaggtgcagctggagagggagctgctgtcccgtgtggggaggggccgccacggcgtacgggggagcctgggtgatggtgccagcggcgccctcatcgccatggtaaccaccctccccctcctcggggtcccactcctccttgtccatgatgctgaggacgtcacccagcatggagggccccaggtcgatgtgggacatggcattcttgacaaacagggccgagtccgcagggagcccagcatgtcacgctgctcccgctcccccctggtcaccgactgtgaccgcttgctgccccggaacttcctggacaggagactgcgtttggaagatgaagaagagggctgttcgtccaaggactcgccgtcgggctcgccagccttgctattgaggaaggaggtgtccccaaaggcgtctccggcccggccaacgtgcatggtgtggcggaagtcgcccagcggggcgctgatcatctcggccgtgaggtccgctcgggaacggcgcttggagtgcaccgagctggacaccagttgcttgaggattggcatcttgctggatgggcggggaggcattcagagtagaggagtgattttgcaaatctggttagagttccagtagcctcggacacactttccctgaaacttgagagagacagaacctttcttgcagaagacaatgcctcccctgcccctgcaagccaggatgctgccagagtaaacatgaccacatttaaggacgcgaaggtaaatccagcaattccaggcagcaagccagggaagagatggagtctatgagttggctcctatgaacagtcagcctggagatgtgctacaacttctgggttggtgagcagatcgaggtaccaggaaggtggtgcgtgccctgccccccaccccaacacttgaccccacgcatcctcatgcagctcttccgtttggctgttcctaagtcgtatcttttgtaataaaccagtaaaagaaaaaaaaccaccaaaaagccacatctttatttacaaaagcaaacgcaggctgggtttggcccatggactgtagtttgctgactcctgaatatcatatatgaccctcttggccagccatgggctcctaggcaaaactctgaagaaaacaggaagggaggaagggagggagggaggaagggagggaggaagggaggggaaggaaaggaaggaaggaaaggaaataaggaaagaaaaaaagaaagagagaaagaaaaagaaaggaaagaaggaaaggaaaggaagagaagaaaggaagaaaggaaaagaaaagcaaggaaggaaagaaagagaaaaagaagcagcagaagaaaagaaaaagaaaaagagaaggaggggctgacatcctacccctaggcggaacttcactttgccgaaacacaggtggcattctgctacacaaggcttgtcagatggaacagcacgctggagggggttgtgcaagaggctcactgggacatgggccacaactctaagaggtgagggactctggctttagtcaccagagaaaaatccagtactttctggaacactcaccagccttaccctgcaaagataggaaagcacagggaaggcggaagactgtgtttcattcaaactgt

SEQ ID NO: 462125 - DNA, 2611 bp, Homo sapiens
gttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagcatgagccactgtgccctgccacaattattgtttaaaatgcattattttattctagatttatgtacatggtgacatctgtgtttcggtacaattttgaacttgtatttcaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggttattttgcattcccactgccagtatatgagaatacctatttccccacagccttgtcaacaaactatgttggcacacttggatttttaccatctgataggtgattagccccactcccttcttttcttttttaacatacaagaacagttcattgtctaagcaaataacactaaacttacagcctgattcatatttattaaaatgaatattctatactgtagattagttagatacaaaag

SEQ ID NO: 462126 - DNA, 1726 bp, Homo sapiens
actcagtcaaacagtgtctggaatggacctccggcaaacttcagcagacgtgcagcagaggggcctgactgttagaacgaaaactaacacggaaaggaatagcatcaacatcaacaaaaaggacgtccacacaaaaaccctatccgaaggtcaccaacatcgaagagcaaaggaaaatcaagaagatctgggcctgtgggaagagaaatttggaaaatttgtggatatcaaagctaatgaaacaaaactcagtatcctggtctctacaggcccttcttctattggtttggatttctccttgcatggatttgagcatctttatgggatcccacaacatgcagaatcacaccaacttaaaaatactggtgatggagatgcttaccgtctttataacctggatgtctatggataccaaatatatgataaaatgggcatttatggttcagtaccttatctcctggcccacaaactgggcagaactataggtattttctggctgaatgcctcggaaacactggtggagatcaatacagagcctgcagtagagtacacactgacccagatgggcccagttgctgctaaacaaaaggtcagatctcgcactcatgtgcactggatgtcagagagtggcatcattgatgtttttctgctgacaggacctacaccttctgatgtcttcaaacagtactcacaccttacagagaaaggctgcagtaagcactgttcatgctgctgctctcccgcctagacaacagagcgagaccctatctctaaaaacaacagcaacaacaacaacaaaattaatgtaatagtgacatggaaaaaatacagctggatgcttaaaatgaatttggacagagtagctccaaaagttctgtgacagcctacctcttttacagacattggagaaaaatagctctcagtctgaggaagatactgagaaaaggaaagaagttgaaagcatcttgaagaaaaattcagattggatatgggattggacaagttggccagaaaatattccccacaaggagttcctctttaaagcacctgaagcacgtagctacccagcatggaatttaaagcctgatgaggaaagggggcattttctcagcagaatttccaaagggttttgctgctgtctcatctggtggccatgggattggggatctatattggaaggcatctgacaacttctaccagcaccttttgatgaataatttgaatccagctttgtgcgtatagtggggatttctatctgagcttgtgacacagctaactcaggagctgttatggtccttggttggctgtttcacttgtttttatttgttctgtaaatactgctttcctaatttagtaaaatgaaagaatagacactaaaatcacactgacctatacttatacctatagaatcagttaataaggttatcagactgattaatatctactgtaacaatttggcagtgagttttctttggatattagtataaatatgtaagtatcgttttaatatattagtcatgatatagtattttaaaaattatctgtaacctgaattctgttaaaacactttatattccaaaagaatgaatgacagtgatattaaaatcactacattaaagggtttgcccagaataaatattgtggccttacttacactactgtggaaaatattatgtttaatttaaataaatgcaggttgtctactaagactacacttaactatggt

SEQ ID NO: 462127 - DNA, 812 bp, Homo sapiens
aaaaagcaaagagcatggctaacagagataccggagaaaatttaacacgagagaatctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatacctcacagcacacacgtggaacaaagaccaacatacactgctacagataagaccaatgacccgaacaggctgctagatgactaccgcacacaagtatgagacagaagcagagccctgacagccagaatgtggaggccgacactcgacggcctgacgcagggagactggactgagcatgaacctggccagagacgaccaggagaatgcagaaagagaaccgtcaacggcggagcaggacacaatagaagacgaaccacacagaggagaagaa

SEQ ID NO: 462128 - DNA, 1541 bp, Homo sapiens
tataggctagtacgagctgggtttgctcactctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaaggaagatctgttcagaactctggtgtgggctcagccacccccatccgatgacctgactactctcccatctccgctgatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacattgagaacctcaaggaggagctggcctacctgaagaagaaccacgaggtgaggtggctggggcagaaggtcaaagatgctgaggagtgggtggcagagccctggggctgggccatggctgaggccgtgcgagagagcacagcaggcgcactgggattagtcaccttagagggcttccctgtctgcggagccctgatccttggggagatgaacgccccgcgaggccaggtgggcggtgagatcaatgtggagatgggcgctgccccaggtgtggacctgagccgcatcctgaacgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatccagggactgatcggcagtgtggaggagcggctggcccagcttctctgcgagatggagcagcagaaccaggagtacaagatcctcctggacatgaagatgcggctggagctggagatcaccacctaccaccgcctgctggagggcgaggatgcccagtgagtgggggagcctggggtcagggctgggggcctcttggcaggggtggggc

SEQ ID NO: 462129 - DNA, 1547 bp, Homo sapiens
ttttgaggatcttattcggcatgcggtctgtagacctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaaggaagatctgttcagaactctggtgtgggctcagccacccccatccgatgacctgactactctcccatctccgctgatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacattgagaacctcaaggaggagctggcctacctgaagaagaaccacgaggtgaggtggctggggcagaaggtcaaagatgctgaggagtgggtggcagagccctggggctgggccatggctgaggccgtgcgagagagcacagcaggcgcactgggattagtcaccttagagggcttccctgtctgcggagccctgatccttggggagatgaacgccccgcgaggccaggtgggcggtgagatcaatgtggagatgggcgctgccccaggtgtggacctgagccgcatcctgaacgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatccagggactgatcggcagtgtggaggagcggctggcccagcttctctgcgagatggagcagcagaaccaggagtacaagatcctcctggacatgaagatgcggctggagctggagatcaccacctaccaccgcctgctggagggcgaggatgcccagtgagtgggggagcctggggtcagggctgggggcctcttggcaggggtggggc

SEQ ID NO: 462130 - DNA, 1428 bp, Homo sapiens
tctaggtagcgaggccgggtgttgctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacattgagaacctcaaggaggagctggcctacctgaagaagaaccacgaggtgaggtggctggggcagaaggtcaaagatgctgaggagtgggtggcagagccctggggctgggccatggctgaggccgtgcgagagagcacagcaggcgcactgggattagtcaccttagagggcttccctgtctgcggagccctgatccttggggagatgaacgccccgcgaggccaggtgggcggtgagatcaatgtggagatgggcgctgccccaggtgtggacctgagccgcatcctgaacgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatccagggactgatcggcagtgtggaggagcggctggcccagcttctctgcgagatggagcagcagaaccaggagtacaagatcctcctggacatgaagatgcggctggagctggagatcaccacctaccaccgcctgctggagggcgaggatgcccagtgagtgggggagcctggggtcagggctgggggcctcttggcaggggtggggc

SEQ ID NO: 462131 - DNA, 796 bp, Homo sapiens
  misc_feature (751)..(751): n is a, c, g, or t
  misc_feature (779)..(779): n is a, c, g, or t
aaggctagtgggcggtgttatcggcgaggctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacattgagaacctcaaagggaaggaacctgggcctaaccttgaaagaaagaanccacgaagggaagggaagattgaaacgncccctgccaaagggcca

SEQ ID NO: 462132 - DNA, 1554 bp, Homo sapiens
actataggcttaggtagaggctgcgtgttaatcggccgaggcctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaaggaagatctgttcagaactctggtgtgggctcagccacccccatccgatgacctgactactctcccatctccgctgatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacattgagaacctcaaggaggagctggcctacctgaagaagaaccacgaggtgaggtggctggggcagaaggtcaaagatgctgaggagtgggtggcagagccctggggctgggccatggctgaggccgtgcgagagagcacagcaggcgcactgggattagtcaccttagagggcttccctgtctgcggagccctgatccttggggagatgaacgccccgcgaggccaggtgggcggtgagatcaatgtggagatgggcgctgccccaggtgtggacctgagccgcatcctgaacgagatgcgtgagcagtatgagaagatggcagagaagaaccgcaaggatgccgaggattggttcttcagcaagacagaggagctgaaccgcgaggtggctaccaacagtgagctggtccagagcggcaagagcgagatttcggagctccggtgcaccatgcaggccttggagatcgagctgcagtcccagctcagcatgaaagcatccctggagggcaacctggcggagacagagaaccgctactgcatgcagctgtcccagatccagggactgatcggcagtgtggaggagcggctggcccagcttctctgcgagatggagcagcagaaccaggagtacaagatcctcctggacatgaagatgcggctggagctggagatcaccacctaccaccgcctgctggagggcgaggatgcccagtgagtgggggagcctggggtcagggctgggggcctcttggcaggggtggggc

SEQ ID NO: 462133 - DNA, 1182 bp, Homo sapiens
gagactgagatgggaggatcactatggtgttcagggttgagactctccaatctcacacgtcccgatgtcacattcagacaccacatgtggcgggccacaccagggtctgtatctgccctatgcccctgcctgtcccctctaccagaatgccctttccccgttgccatggccaccattctggtctctccgacaaccccctctcggagttccagtggcttctcccccctctggctcagaggcccaggaaagagagagaagaccaaccaaggggtggctggagtcccaaggccatgaactttcaggaaaatgtgaccctggccatggccttgttcaccatcctgacctccatctatttcttcaacaaggctcagcagtgagaagacacaggacctccccgcacaagagccctgcctctccctctgccatcgctctgaggccagataaatgagaggcagagaatatcattgcaggatcctgctttttaaaaaatgctccatgccaagggcagcggctcacacatgtaatctcaacacttcgggaggctgaagcagaaagattgcttgaggccaggaattcaagaccagcctgggcaacatagcaagattctgtctctacaaaaaaaaatttaatgagggcatgatggcacatgcctgtcgtcccagctacttgggaggctgaggcaggaggattgctcgaggctgcagggagctatgaccatgccactctactcccgcctggtcaacaaagcaagaacctgactcaaaaaaaaaaattgctctaaagtttattattggaacagttaggaaatttgaatatggcctgtttattagataataccaatggtaaagttcttgagggagataataatattataattttacagggaaaatgctcttgttcttagaagatacaggctgaagaattaataggtaaaatatcgtgacgtcctacctgcgccgactttaacacagttcaacatttttgggaggtacctctgagcattgtgccccttgcagcacagtgggtatgctgagggctccctccctgggtttcccagacctcatgtccccgtcttgtctgctcatcatactggagaaaaaaaaaaaaaacttatatttttaagcctctaaacatggaaggtttttgttacacagcaaaaggtaactgatacatctgcattcc

SEQ ID NO: 462134 - DNA, 3519 bp, Homo sapiens
cagcaagtatgcgggttcaccgcaggttaattgggaataatgggtttcattccaaaccatgagaaatgatatttcagagagagagagagagaaactgactctgttctccctcactgagtgtcaggaccatcccttccctgcacatttggctctgctggtcccggccaagtctctcgagtctagacatctgggcctgggcttttgttgggcagacggtggagggtcggaggctgggggctgaagccagggagatcaggtggctcaattgcatcattttcccttctgaaatcagactgggcagcctggcgtttaatccttcagcgaatgtgtattgagtggctgcgtcaggcaggacgctgcggtctgtgcacctccgtgaaaccacatggtgctgaacagaagctgcctggggtgatggaggcagcatcgaccagatagtgcagtctaacagaaataaaatgctagccccacatgcgagcacatgtgggattttaaatcttccagcagccactttaaaaaagtaaaaagaaacagtttgagaagctaccagccgtcccagggaagatgtcaagtaggcagctggcgatatggatctggagctcaggggccacaatggacctccaccccaccccacccctgcaaatccaacaaccctgcccccaggtagacaaccttctctcatctgcccactcaacaccatttgcttagggatgggactggaaggagggaggtttggcggcttgggtgagaggcagaaggaactggaagggggcacggacagggtgcacagccacagaggaaagaaggctccaaaccaaggggctggcaggagtcttgactcagggagcagcatcttctccctcctctcgggggccgggctctgccgtgtcctgacacagggagtggtggccgagcacagggccaccactggatccccagctgtggctgtctttaagaacaggcctgggacgtgcaagctgttgatacccgtcaccagggcccagattggaacccagagccagccagtggggggatgaggggagctgcatttggggagggcccactgttgcccaggtgcttaatatgcacgagcccgtgtgaccctgtctgcctccctgccagccaaacatacctgtgtcagaggcctcccatggcttagcaagcttctggcttgcctcccgttcttcctaccctattgagtccctgtatgtattacggcaaatttagaaatttgtgggcacgccacagaattagaacactggggaagcatggtttggacttggtgcaagcgtcctgccttctacatagggtgattcagtgtattgagggaataaggaatgggtggttcacatttctgaatttcctactgagttggaaggtatgcagaaaaaacctttctgtagtttcaacacctgttaccaaaacgcttttgcaattgtgcccttttcctttcctgcccagggaagtggagtatgatgaataggatcaaatttctctggatttatcaggattttgtgtgacttcaggatcattgttcctaaaggcctgtccttgttcaggagtgggtatgaagggagggaaattaagctgaataagttatcagaagctagccctaaaagctgcttttcaggagaggggaagaaaaaaccgcactggctttggttgaaatgcgccggtgaggactgagcctgactggcaccggggagtgtgatcggctgttttggccacctttcaattaactgaaggctccagttaattggggtttggctacattttctcttgacactggtgctcagggtggcctgtgccctgctgggcctgacttagtgacatggctcaagtccccctgacttcctcctcataacctgccttgcctctctgaagcctaaatgccttggtcggcattcttccacggaaccctcagaagaaactacgctgacatgttaagctttttaatttagcacacacagtgcgtacatgcccccagacaaaacagaattgattgataattctcttaatggaagcacaggcttcagttgctccagaaatagatcgttacctcggccaccttttgtaattttctccctcccatttttttttttttttatcctactgtggtctaaaaatatgatgtttcatttcatccttctttcataatccactaaatgccagggcatttcttttcagacctttaatttatagcatgtttgttcagtttcacttcattaattaatgctcttcccaggctcccatgacagagtctttgtgtaatgctctcttacagtaagcaggtgcttttatccttaatgaacaatttcctggaaaacactgaaatacacaacgactaatcaggccaggcacacagtgactctgggacttatgtaccattttccaaattaaacctggggagatgagggacagattttgatcggccacagtactgttttttagtgggtctttcctttgggagggcatatagggtgctcaagttctggaaggtgggtgagcttcttgctcctccaggaaattagagttcagaggaattgtttgattgcaaatgcatgtggctgtgagatggttgtcagacacagcctaggccagaaatgcagccaaattggcctctggtccagacttggaatcatcactagcttagactgcaagtcagcagggcctgggctgggccaaattgcaaacttactgaaattcaccttcagttcctttcttcccttctggcagacttgccccacccccgggaggcagtccttatcaggcccaggaccctaatatactcattccccctgtgcacccccagtagtatctgtactgcatcccatacgccccatcagagaggacaatgccaaacccagccatgctgatattttccctggggctatgctgttcacaggcccttctcataacctgtgtctctttggcatctcaaccttgggagtcaggtttattactaaccccattttgcagaagaggaagctgggagcccgggaggttaaatgaccatccttaggccatgcagttgtttatataaatgtgatcataatgttcatgctgctttgtaacctgcgtttttcacataataagactttagggtcatcttcccacccagcaaagccgatccaggccggagcagaagccctggacaggaggagggatcgtttgctatgatgccagtgtcccttaagcaacctggcggcattttcctttaacaccaggtgccaggcataagaggcccttgagtgttagaatagacaagtgcatgcagactctcaggacacagcttgacatgcaccaggcctttcttcagacttggtgttgagggaggggagcagagtttcctaagccgctatcatcaggaacaccgctcttagagctgtgtcactgggaagagttccatgggaaatattgggtgaaataaaaagtcaaatggtctctttattttgggtcttctcagagtctaagctatgctaaaatgcttagactgaatatttaggatgaggacatagc

SEQ ID NO: 462135 - DNA, 843 bp, Homo sapiens
ctctccctgggcctgggctgggtgacagaagcctgtctcctccactgacctggactccgcctggccaggctgtcccctgagacacagccgagtgcacattcggccatgggccagcggctgctccacagccagaggatgcctgcatgtggctgctgtagagtggctgtggccgcccccagagcccacagcaagggcagggctccttgccagctgacccacccaggaggccttaccactgcttgtaacaccattcttctccaccctggtttcactgatgaggaaactgaggcctatgaggagatcagaagtgccctgtggccactccaggcttcaacatgggaccgtggcgccaaagctcagcccagccacgcacagggcttctctgctgtagcgaagcctttggattctccagtgagaaggttctgtaggctcctagaaaaagcacgggagaccatgggcagtcatagttcacatctgtcatctgggaaaaattataattctgttctcttacactctcaaaatcatcacggtttgatgtgaaactggtaagctctgagcggggttgggagtgcatcaatgcgttatctggctgtggtagcagatgagttatgcaaaatatttccgctggggaaagtgggtgagggcatatggaattctgtttgtgttaattcttgcaacagtgtgcaaatctacaattatctcaaaattaaaagtttttaaaaaattatcctggttaaaaaaatatattacatggtcaccctaatttcaacagcatcctgtctgactcctctaattttcatctgtctttcctattccttttacacagcaactaatgtcatgtgc

SEQ ID NO: 462136 - DNA, 858 bp, Homo sapiens
tcattgctgtggaggagacggttatgggctggggcctgggtcttccgccccttcctggcagaccaggagcttcagttgctctctgtgaagttcttctttgcaggagcctgacacagacgacagccccagatgttcttgctactcaccccgaccttgcggtcttacccttctggctgaacaagagacaaacagctcctctccacttggctgtgtgcggcttaacgaatgcgtatgaagaccgtataaataattcacatcactcaagaggtggcgagctgaacaagtcccttctgggttctggcaaaaacccgttcagaactccgtgtgacatgtgcagtcaccttgcccggatttctctcggtgggaagcgacgtctgcaagagaggggacggcggctgggctggatggctgcctttgagtccgtcctgcggtgaggctggggaaggcccattccacgcgagccttggcttcagccctgaggtgcctgccagcccccgtggcagaccccggccctgccaatttcagcccccttggtgattctgttccagcgctcgccaaaagcagaatccgtgtataatgaacaagtttcatgttcaacattttaagtgtctatttatgagtcccagtaattagccctttgtctgcaattctggcgatgatgattagaattccatctcacgttatgaatgctgctccccaaacttgtccttctcgcctggagaatcccaagcaggtgaacaagaataactgtttctccaattacgggacattataagttgtttccttcattctgattgaatgcacccacgtcgcttgccacatttggaccaataacagatcccagaagaaaaccatgcc

SEQ ID NO: 462137 - DNA, 434 bp, Homo sapiens
ttcctctctccagaggacctttcctgcctaggactcatgattgtcccctccctgctgttgcctagtttcctggtattaaggagaatcaactctctggataaacgtggtaaatatggcccatagtcccatctttttacaggcattttttacacctggagcagccagaggacgcatgcatggctcttcggaaggtaatttagggatcacccatgtaagtttcctaaggatttctttaacatggttcttctgattcagtccggccaattaaatctaaatccacccctgaaagccatctggtgtggataacaagcccacaaattgagcagtcagctttttgtgccctttaggcttgggacaaccacgggatctaaaaggggctggaactagaggtcttgagctcctgttcctaaaatcatcttcatcctatatctgca

SEQ ID NO: 462138 - DNA, 883 bp, Homo sapiens
gtataattgaccatggatatccgagtcagtattgttctgagcttctggattgttgaagtctgctgggctgtggtggaacgtagtctcctgggctcttcagagccactggccagagcgtctccccatttccttgctgtgtaccatgcagttgcctccctggccactccccctggtatctggatgatgtctgccacagaccttttctatggggacccctttgcctttccaggtgggccatttgggaaggatttggaccgaccccagtgggctctccctggtgacacgaaccttttgctgtggctgactctaaggttaaggtggtcccagccccaccctttgcagcaggagacagcccatctctctgggtctctagcattcctggatctgctgggtgtctgtatttacaaagagaaggggccactcgtgtgtgagcagcaccgagggacagaggtaccttgcctgcttgtgtcccctccaagtccttctgatattttcctttccagctgttgcctagtttcctggtattaaggagaatcaactctctggataaacgtggtaaatatggcccatagtcccatctttttacaggcattttttacacctggagcagccagaggacgcatgcatggctcttcggaaggtaatttagggatcacccatgtaagtttcctaaggatttctttaacatggttcttctgattcagtccggccaattaaatctaaatccacccctgaaagccatctggtgtggataacaagcccacaaattgagcagtcagctttttgtgccctttaggcttgggacaaccacgggatctaaaaggggctggaactagaggtcttgagctcctgttcctaaaatcatcttcatcctatatctgca

SEQ ID NO: 462139 - DNA, 973 bp, Homo sapiens
gtataattgaccatggatatccgagtcagtattgttctgagcttctggattgttgaagtctgctgggctgtggtggaacgtagtctcctgggctcttcagagccactggccagagcgtctccccatttccttgctgtgtaccatgcagttgcctccctggccactccccctggtatctggatgatgtctgccacagaccttttctatggggacccctttgcctttccaggtgggccatttgggaaggatttggaccgaccccagtgggctctccctggtgacacgaaccttttgctgtggctgactctaaggttaaggtggtcccagccccaccctttgcagcaggagacagcccatctctctgggtctctagcattcctggatctgctgggtgtctgtatttacaaagagaaggggccactcgtgtgtgagcagcaccgagggacagaggtaccttgcctgcttgtgtcccctccaagtccttctgatattttcctttccagctgttgcctagtttcctggtattaaggagaatcaactctctggataaacgtggtaaatatggcccatagtcccatctttttacaggcattttttacacctggagcagccagaggacgcatgcatggctcttcggaagccttctcctgccacggcatgcacccacacatgcgagcctcccgggtactgtcatcctgaattctgagaccatccagcacttcctttagttttgccctggtgctgttgacttttgtttactgaagagtgtgctggaggcaggacaagggacatggaaggctgcaatttaagagtctaaaaggttttagaatcctgaaggaggtttaacaagctgaattgaagaataatacctttctcaactggagagaatttacatgattgcattattgttaaaattaacatctcatctattaaaagcatttgtagattatctttgtaccttcactttctttgt

SEQ ID NO: 462140 - DNA, 513 bp, Homo sapiens
tgtaacttcacatgcagccaacatgctgcaagtcccaactggcccctgcaccccactcttgcagaacgtcccccacaagtcctcactgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagc

SEQ ID NO: 462141 - DNA, 576 bp, Homo sapiens
tgtaacttcacatgcagccaacatgctgcaagtcccaactggcccctgcaccccactcttgcagaacgtcccccacaagtcctcactgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggtgcgtctctgcgacaggggccacgggcctccggaatcctcaccaccgaccctcccctgcacggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagc

SEQ ID NO: 462142 - DNA, 3277 bp, Homo sapiens
agcagtaaacaagtcatgaaaatgaataagattctacataaacttggaagtcagatttgtgtcttaaaggttgagtggcagttcatccaacaaacccgaaaggaaatcccaggcttgggagacagcatgtacaaagacatagatgtaagaagaacttccttcctgaagtccgttgctgcttttgagaactgttcaggccatttctgctcgagtgacccatggcaatccacgctcaccactacctatatctggacccacgtgtgtaaaggttgtatccaggatgtgatttcaaaggtccaacaaatatccctttcctctcagggtactttaaacattcactatcaaactaactcactggatactggttccagtcttgctactgagagaggccacttgtacttcccagaccatctgggaagtatagaaactcctgatggaagcagtacagattactccaaaacacactggaatgagattacgggccctagaatcttcttctgggcaaagggtaacaattcagagatgggcagtccaaagctggtggctctgcttcctccatggaaggaaggtagagcccagaccctggtcctctctgccatccccgacatgtggctcccatctctgggcccaaggcagctgagccagctcttgtcattccctgaaggggctctgggatatgatggggaaagagctatgcagagtagtgagtacaaccttttagcatctctagaagaggcagtattgtggaagcagttccaatggtaactatctgaatggtgccaggacagtgtaaatagcattaggaccagtattgggttagagctggcattagcagacacacgagtatattttcttagaactgaaaggcatcttagagctcatctattccaatcacctctttatataatcaagaaaatttgagaacaccatctatttatttatctttagggcaaaggattgaaaagaagttcacaacaaaaaagtttgaacacaagcaaacctgaaacagatgcagggtagtagatcttaagggtgcgttgctcactccagggcctgctgccacccagatggctggcaaacaccaggactccgaacacaacaggattcagggattcagacaggagtcttgctctaccaattattataggatcttagatgcctttccagtaaagctaacaaaaaacaaaacaaaataaaaccatatccaaaatactaaacagctgtctccaagatcagaaggcatcagaaaagaccctcaagagttgtctaatcccagaggaagatcttaagtggggatgtgctcacagcagaaaccttggaaatttcagggagtgaaattttattgtcagaactttcaataaaagtgtagccacagatcctgggagcattaaataaaaattaccaacaagctgtcttacctgtgtgcactccactgaaaggaagggcaaacatgagcaaggagctcttgtacatcagtcaaaattctgacagctaccctgtgaagtttgacgggctgccatgtgctagactacctaagatactcttaactgaaccataaaaagacaaataaattagtaattgtatccctcctgtcaatgtcctttttcgtgaacttctcaaggtgttggttaacattgtctggaatgatttatcaatatattcttagctttcttaggaaacacagatagacttgattttttccaaattgttttttgaattgatttaagaaaatgatacagatattgccaattgctgggcctctctttttcactccctgctctgcttcctccgattattaaatcaaaccaataagattaacataatctttcttagaattgactgttctttttaaatagatcccatgatagacatgtgtaaaaatcaataacaggcccctcatttgtcaaagctaatgactaaactcattttgaagttcaatagtggttactggagagtggccacacattatatgtctaatcctgtatgtctcgacacttattctgcagaacagagaaaaaggctttgttgcttgaggcacagtataaaagctggtgtctccattgtatttgtacatattcacatttcctccaaactatgacaattgttgattgtccaagctaatacattaaaggaaataaaaggaaaaataaatctggtaaatttgtaacactccccaccccaccttttaaccaattcaattaattgtaatggattttaaaaactgcttgagggtgggggagagagaggaggaaaaggaatccacaggaacaataactgaagtggagtgatatattcctgatgggagctggagaactgttctttataatagcttctcaggggagaagccgcccttttccagcaggaggtgtcctgggaatagcagagccactgccattccattcttttgatgaacagaaaccttatcagtgtaattccccttgagagctgaagggagaaggaaggagtttaaagatttgaaaaatttgggttgtgaggggtggaaagcccagactccagcttgttcatttggaatatttcttgtgagggggaaggtattctgccaaatttagggtcctttcagagctcacagattctgacagctgatctaagttcagtgcatgagtttatccttgccaggggagagagggagcagtaagtgaaaagaacgttttatgaattaaatgcaaaatataaaaaccaaaatgcttgcctccaatatatcacaatatgctaatactttcagttgcagctatgcaatgaggatgtcaaagcattagtcattaaataataagtcgcatcaataattttgactttagaataaaacacagatacctttgatttgcacctcgtttgactttttaattatttttagaagctcgaaatatctcttggctttttttctctcattgtgacaagactatgaggttggaaaaatcaaggaagcaggtgaaatgtactctctcatatcatggttgtgtggtatctatgaggcaaaatattcttttttttctatccataaaattgccaaagccttaattatttggtgacataagatgagtaatctaaagccagtccatgttcaatattaggctgtttggggatacaaaaaaatctgggttataatgaaaagcactgtcatttcatgaatacctctcacatgaattgcacatgtgtatttttttcatttatattgttttctccaatggctttatccaacaacagtttgtttcatgaccatgtcacgtgttcagtgcaggtccgtgtggtggttctgctc

SEQ ID NO: 462143 - DNA, 3937 bp, Homo sapiens
  misc_feature (2)..(2): n is a, c, g, or t
  misc_feature (7)..(7): n is a, c, g, or t
gncctgngccaggaagaggttctggcggggcctccgcctgaggccacgcccctgggacctgtcccgtgtccacgtgaaagcggagcggagcattcaccatcccctccctgaaacagcggtccccaatgtgctccacaggcagggccgagctgggcaagggggagcccagcccctgcacgggccgccctgagcggcggggacgcaggaagacctcgccggctccaccagcccctaccccagatgcggggcctcagaccagcgatgacctggagcccccgccccacggttgccaggaggcggacaggggcagctcctggggggctaccgccccgaggccattccgccagaacttgagcgacttgggaaggtgcagtgccctgcccttgaagaagaacctgtgtcctggaggcagcagcctgggagctcctcctccgaggacaccgcagagaagagtgactctggcggtgcagcgctggctttcccatccgcggaggagagctgtggggctggtggggacatgggacgccgatgtggacatcagggactacattgggaaaagggcctcccagcatgtgagtcagagcatcacagaagagattgagaccctgatgggagtcctggacaaggacgatggggagagcaccgccagcagcgggggtggggacccagagcagccactggaagagaaggagtaggaacgctctcttaaagtccacttatcctattccttcaaattaagaccaaagtccaatgtatttaggtaaaaaataatttcttttagaaaatgctaagagattcatcataccttgacctgtgccccatttccctcctccacctgtctgacctggcattcctatttcgggagaccagaagtggggggaagagaagggatgactgtttctttgctttcaccattcctgcatgccatgcaaaggaaggaatattgcacttttaaatatccgttttattaagtaagtggttactctttcaaggacaaaaaaatgcaaattgttacaaaactggtagtatttgtaagtgcaagcactacatgctgccttgttcttttaccaattgcatttgcattttaaggtactactggtacagccatggtggagaacagtttggaggttcctctaaacactgaaaatagaggtgccaaatgatccagcaatcccactgttggatatataccccagaaataagaaatgagtatatcgaagaaattatctgcactcccatgttggttgcaccactgttgacaatagctaagatttggaagcaacctaagtgtccatcaacagattaatgtattaaagaaaatgtggtagatacacacagtggagtattattcagccctaaaaaagaatgggattcagtcatttgcaacaacatggaaggaactgggtatcattatgttaagggaaataagccaagcacggaaaggcagacattgcatgttctcacttatttgtgggatctaaaaatcaaaacaattgaactcatggacacagtaagtactagggggctgggggggggagacagggcacgggtaatgggtacaaaaataggcagaaggaatgaataagacatactatttgatagcacaacagggggactctagtcaataattgtacatttaaaaataactaaaagaatctaattggattgtaacacaaaggaaacatgcttaaagggatggatacccactctccatgatgtgattagttcatgctgcatggctgtatcaaaacatctcatgcaccccataactatatatgcttattatatactcacaaaattgcttgaaaataaaaataaaggaactactgaaggtcaggtcagagtggaaatgtaaaaatactaattagagaataatgtgaatacaacaggaatcctgttggtattctatttatattgtaagcagcagttcaattgttttgtaaaagtaatttcaattttaatcactgaactaaagaaatgggcaacgctgacttccgtaatataggttctacctaaccatctctaacaccgctgtcaaggaggaccagtgttaaggtacattactaacaaccacacaaatttttaaaagaaaagaacactcttagcagcctatggtactttgaaatgaaatattgcctctcattctcacttgtgttgccattccaaaagtttgaatttgctgaggtttatattctgcgtattatataaccattggttctatttggcataaccctattaaatggtgctcagagctgaattatgtacagaaactttctggtttaattagcataaattggtataaatattagtgagcccatacatctgtgatataattaaaccaacttaatgattctcacataaggtgtcaatttattttactaatgcattcataatctatgctttgtagcaacatttttcaaatgtttaaaatgctaaatcttctcaattttccaatcttttcttgaatcaattagatacctataatgtagttactgaatagctgggaaacaaatacacctagttagaaatggcactgctttataaaaggcactagagaaaagatgagactattcctatatttaaatgctgctggcaagtgaattcctttgtatataaatgaaagataccattcattaaaatgaaagacttgttttaagtgtgattcttacatttcattcatttatgatagagtaaatggctttataattactttaaaatttaactcactagtacattaaatctgttcattgcaagattagaatcaactgtgaggggaactaatttaaacaagcccttccttagtcttattgagtctcatatttgccgaaagtacctacagcttgcaggataagggagttcacggaccatagggtgagtgaacccatgcacaaattgcaaactgcccagagctactacatttaggatttttagacctttaattttccaagtcatagaaatttgttacaggttcatcacatctttgtctaaatggcaactgaatttctttaaagataggttaaaaaaaggcataaaactatgaattattatccatttgtgtgcctctatttttgctttagaattatggaaatggaccctgtgaatttgggaaacactgttatgtatacacatgggtgaaaaacaatctaacattgtgtaaattaaaatactttttttgaggttgaaaagcatccatttgttctaaatctatatatattatgtgtatctagtacagaataaggtgtaacttctcattgagtaatcttaggttttacagatatgtaaagctgaagcaactctaaagagtagacacttcagaacaggaaggttctggtcaatgttgagagtagacactttcactgaaggttctggtgaaatgtgggtaactaattgcttgtaatctataatttgctgtatacttaactattaagttaaaatgtcatttaccatgctttttacactaaaagctttaacttttctgagaaaataatattttaaatgttcaattattacttctgaggaaagctacttctagcattctttgtcatgatgtgcttgtgtgcagtaagcagagcattttcagccacttacctctacaatgttcctgtttttcaatttctgatttagattataaaaggcaaatgattaatttaatttgatactcagagttgtgtttacttttaatggacaaatatatgtcagatactttgatgtttattgatatgacaccgtgtggttaaacaatgaaagtatgtccatgtgtttcttatagggtacacttgaaactagtggtgtttatgcagttcacttatgtaacttgaaaatctggtactattgcattcaggactgaaatcttggagtttaggtgtcttgtctctcattttgaaaataagtgaaagttgagaatgtaaaatctataaagttcatttttttaactagg

SEQ ID NO: 462144 - DNA, 753 bp, Homo sapiens
aagaattcggcacgaggcctcgtgccggcacgagggtatctagtacagaataaggtgtaacttctcattgagtaatcttaggttttacagatatgtaaagctgaagcaactctaaagagtagacacttcagaacaggaaggttctggtcaatgttgagagtagacactttcactgaaggttctggtgaaatgtgggtaactaattgcttgtaatctataatttgctgtatacttaactattaagttaaaatgtcatttaccatgctttttacactaaaagctttaacttttctgagaaaataatattttaaatgttcaattattacttctgaggaaagctacttctagcattctttgtcatgatgtgcttgtgtgcagtaagcagagcattttcagccacttacctctacaatgttcctgtttttcaatttctgatttagattataaaaggcaaatgattaatttaatttgatactcagagttgtgtttacttttaatggacaaatatatgtcagatactttgatgtttattgatatgacaccgtgtggttaaacaatgaaagtatgtccatgtgtttcttatagggtacacttgaaactagtggtgtttatgcagttcacttatgtaacttgaaaatctggtactattgcattcaggactgaaatcttggagtttaggtgtcttgtctctcattttgaaaataagtgaaagttgagaatgtaaaatctataaagttcatttttttaactagg

SEQ ID NO: 462145 - DNA, 3804 bp, Homo sapiens
tccccagtgcccacttttttctgttaaaaattaaactgagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggagaatggtgtgaacctgtgaggtggagcttgcagtgagccaagatcgcgccattgcactccaacctggacgacagagcaagactccatctcaaaaaaaaaaaaaaaaaaaaaaagacttggccttgtggtgaggggagggcatctgtaaactcctggacctgtttttgccttacttattctctaaagactaaaatatttcctaaaatgtacaggcactgtttaccagaaagtaccttagttaaaacatataaatttgtttatgccttataaagctatattttttcaaattgctttactgagtcataggaggctaataaatttgtgtaaattgtctaaatacaagcctgtcttatatttctctgataatgtgctgctgataatgtgctgctgaggctaactttctctgataatgtgctgctgaggttaacttgtcaacagcctgcttatctcagcagtgtaaagttaacagcaacatggaaaagtttcttttatatattatgcaatggcat

SEQ ID NO: 462146 - DNA, 4856 bp, Homo sapiens
tccccagtgcccacttttttctgttaaaaattaaactgagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagacttggccttggctgggcatggtggctcgcgcctgtgatcccagcactttgggaggccgaggtcaggagttagagaccattctgaccaatatgatcaaaccccgtctctactaaaaatacaaaagttagcagggcgtggtggcatgctcctgtaatcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctataatcccagcactttgggaggccgaggcgggcggatcactaggtcaggaaatggagaccatcctggccaacacagtgaaacccagtctctactgaaaaatacaaaaaattagtgaggcgtggtctcaggctcctgcagtcccagctacttgggaggctgaggcaggagaatggtgtgaacctgtgaggtggagcttgcagtgagccaagatcgcgccattgcactccaacctggacgacagagcaagactccatctcaaaaaaaaaaaaaaaaaaaaaaagacttggccttgtggtgaggggagggcatctgtaaactcctggacctgtttttgccttacttattctctaaagactaaaatatttcctaaaatgtacaggcactgtttaccagaaagtaccttagttaaaacatataaatttgtttatgccttataaagctatattttttcaaattgctttactgagtcataggaggctaataaatttgtgtaaattgtctaaatacaagcctgtcttatatttctctgataatgtgctgctgataatgtgctgctgaggctaactttctctgataatgtgctgctgaggttaacttgtcaacagcctgcttatctcagcagtgtaaagttaacagcaacatggaaaagtttcttttatatattatgcaatggcat

SEQ ID NO: 462147 - DNA, 4167 bp, Homo sapiens
tccccagtgcccacttttttctgttaaaaattaaactgagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagactcggcctctcaaagtgctggatttacagacatgagccactgcgcccagcctcaaccctaatttttctttcactcataataccaaaagttatctcatgtatctctgagtaccttcttgcccaaaaccagcagcgccatacctgctgtcagcaagggtgtaatataccatagtgataaatatgaccagaagacataaatgactgtgggatgtatgagaattacaagtcacattggtaagaagataaaaattttcgtcatgtttatgatttgaaatatgtttacttctatcagttttagaaatacagttacaaaatg

SEQ ID NO: 462148 - DNA, 4688 bp, Homo sapiens
tccccagtgcccacttttttctgttaaaaattaaactgagctactcaggaggctgaggaagaagaagtgctagaaccccggcagtgagccgagatcatgccattgcactgcagcctgggcaacaagagtgaaaaaaaaaacaagttgctttgtggaagaaagtaagtatacacagggagaaagagatctgatgaccaaagcagggaatacgtgtttggagtccacggcatcctgagaacttcttgggaatagagtctaggcccccagtgctgtcactctcacccatcttcttctacacatgtgagatgtttcaggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagacttggccttggctgggcatggtggctcgcgcctgtgatcccagcactttgggaggccgaggtcaggagttagagaccattctgaccaatatgatcaaaccccgtctctactaaaaatacaaaagttagcagggcgtggtggcatgctcctgtaatcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctataatcccagcactttgggaggccgaggcgggcggatcactaggtcaggaaatggagaccatcctggccaacacagtgaaacccagtctctactgaaaaatacaaaaaattagtgaggcgtggtctcaggctcctgcagtcccagctacttgggaggctgaggcaggagaatggtgtgaacctgtgaggtggagcttgcagtgagccaagatcgcgccattgcactccaacctggacgacagagcaagactccatctcaaaaaaaaaaaaaaaaaaaaaaagacttggccttgtggtgaggggagggcatctgtaaactcctggacctgtttttgccttacttattctctaaagactaaaatatttcctaaaatgtacaggcactgtttaccagaaagtaccttagttaaaacatataaatttgtttatgccttataaagctatattttttcaaattgctttactgagtcataggaggctaataaatttgtgtaaattgtctaaatacaagcctgtcttatatttctctgataatgtgctgctgataatgtgctgctgaggctaactttctctgataatgtgctgctgaggttaacttgtcaacagcctgcttatctcagcagtgtaaagttaacagcaacatggaaaagtttcttttatatattatgcaatggcat

SEQ ID NO: 462149 - DNA, 1141 bp, Homo sapiens
gcccaagccacaccctgtaagagcctggaaccacatatcatcctatggacaactggcctgaatctccttggggactccaagtggtaagacaggatcttgctacattgcccaagctaatccccaactcctggcctcaagggatcctcccacctcagcctcccgaagtgctgggattacagatgtaagccaccatgcctggcccctagatgcttcaaaaggatgtgacattcacttaaagaggaattctacagttttttgagacagggtctccctctgtcattcagactgtgcagtggcatgatcacagctcattgcaccctctacctccaaggctcaagcaatcctcccacctcagcctcccaagtagctggcattacagcgctggcgtgtatgaactcatcgcaccctcccaaccagcccaggaggtatcagaggagtaaggttggatatcatcagcacaagtctcctaaaggtcaccccactgatgacaggcctggaggcgcgcgaggtcggtcgacgcccttcgcctcccgcaacgccgctgtgcggttgggggcggtgcggtccctctgccgccagcgcagcccgcgagccgtcacttcctgtgggctgggcgagccggctgcgcgcggagaacctgggctggaggtgctagggagctctgggagcctgggctgcacgcagggaagtgctctcggccgccggggtcacaagactccagggcttcacagtgcccaaggcttggtggacatcgagccaccggggaatctttgccatcagcgccgtgttttgatgcccgcggcaaggaacaccacgaaataggtttcctgacactcagtagatcattgtatttgtactatataacattccattacatgaacatgccacatattcttcgtcaactgttgatggacatttgtgttgtttccagtgtgggcgcttatgaatactgtggctatgaactttcttgtacatgtctttgggataaggtgttgatcatgagagcactccctagtcaactttctttcttttttctccctctaatccaatatgattgatatccctaatcaacttcctgcatgctaatctccatctcaggatcagctgcctgggaacacaacctacaacagcttacgttatt

SEQ ID NO: 462150 - DNA, 2713 bp, Homo sapiens
gtggggtgtggggctcgggagcagggctttgtctgattggccttcatggcagcgcactgcactcatacacttctcttcccccagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctggccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtggcctcagcccccttaccccacagagcccgaatgcactcctacctcaagtccccttgctggggaccccctctcccttcccacactgttgtccagagtta

SEQ ID NO: 462151 - DNA, 3462 bp, Homo sapiens
gtggggtgtggggctcgggagcagggctttgtctgattggccttcatggcagcgcactgcactcatacacttctcttcccccagccatgtcggacttccacgtgcatccccaggccaccgtgggtgaggagggtggtgtggcccgcttccagtgccaaatccatgggcttcccaaacccctgatcacttgggagaagaacagagtcccaattgacacggacaatgagaggtacacattgctgcccaagggggtcctgcagatcacaggacttcgagctgaggacggtggcatcttccactgtgtggcctcaaacatcgccagtatccggatcagccacggggccaggctcactgtgtcaggctcgggctctggggcctacaaggagccagccatcctcgtggggcctgagaacctcaccctgacagtgcaccagaccgcggtgcttgagtgtgtcgccacgggcaacccgcgccccattgtgtcctggagccgcctggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaaggtgaggcctgggtgtggagcacaaaaccacaggcactcactcagggtatcagagcagaaccaccatgcacacttgttctggttgtgcgctgtgcagggtgcccggccctgaggctgtcagggctgagtctacttggaggaaagggcttctttttctaattcctaggaaggtgctgctttcataagcacatgcccttggccagaggccagagggctgtcaggattttgggggtcggggtcacaggtggaaggtagaaagatagagcttccactgggtcctcacatcgtggcctccttctctacctgcagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctggccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtgcatccttgatggggatgcccatgaggaacctgggcttgggagggtggcatcagctggccgcctgcctcctgtcctgcaggcccggcccctggaatgtaccatgtgtgggatgggtgtgtgggagggtgagggggtgtgggtgtcccctgcagaggcgccccagcctcaggcacccagccagcctgatccacccctcgacaggggagcatccactgtcagcagccatggccggaagctatttttatacaagagcagccccagccgctcttgtttcccatggtgctgacacttctgaaagggacaaggccagttatcctgcagagtaacccacagtgtggatttgtctcatgtttcctcctgactacttagtcagatatgtttggtgtaaacagctcagagggcaagctgtgtccttttcagtgcattacatctggaggctcccgatgctggcctggcctgattttggttcactgaatttctataaaaccgcagtgtacagttaggagatattattttagaaattaataaaaagtgtgaga

SEQ ID NO: 462152 - DNA, 2279 bp, Homo sapiens
gggaatgtggaatcctgtttgttctctgtgggggtccattctatccctgtgacctgggaagaggatggtcgccctatcggggtggagggcatccaggtgctgggcacaggaaacctcatcatctcagacgtgacggtccagcactctggcgtctacgtctgtgcagccaacagacctggcacccgggtgaggagaacggcacagggccggctggtggtgcaagccccagctgagtttgtgcagcatccccagtccatctccaggccagctgggaccacagccatgttcacctgccaagcccagggtgagccaccgcctcatgtcacgtggctgaaaaatggacaggtgctggggccaggaggccacgtcaggctcaagaataacaacagcacactgaccatttctggaatcggtcctgaggatgaagccatttatcagtgtgtggccgagaacagtgcgggctcatcacaggccagtgccaggctgaccgtactgtgggctgaggggctccccgggcctccccgcaatgtgcgggcagtctctgtgtcttccactgaggtgcgtgtgtcctggagtgagccgctggccaacaccaaggagatcatcggctacgtcctgcacatcaggaaggctgctgacccaccggagctggagtatcaggaggcagtcagcaagagcacctttcagcacctggtcagcgacctggagccctccacagcctacagtttctacatcaaggcctacacaccaaggggggccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacaaccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcacttgcatcatcttctgtgtcctcttcctcctgttcggccaaaggggcagggtcctcctgtgtaaagatgtggaaaaccagctgtcccctccacagggtccccggagccagagggaccctggcattctggccctaaatggggcgagacggggacagcggggccagctgggccgagacgagaaacgtgtggatatgaaggagctggagcagctgttccccccggccagcgcagcagggcagccggaccccagacccacacaggatcctgcagcccccgctccgtgtgaggagacccagctctccgtgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttggatggtcctgggggctccccagcatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctcagccggaatgaatgtcctggggggcagtggggcggtggcctcagcccccttaccccacagagcccgaatgcactcctacctcaagtccccttgctggggaccccctctcccttcccacactgttgtccagagtta

SEQ ID NO: 462153 - DNA, 1030 bp, Homo sapiens
gccatcacgtggtgcaagagttctgagggaccgcaatcctgaagacattgaatggctgtgttcctgctcattgctggaggcactgtcaggggccctgtcctcaaccccgggtctgacacttgcagatcaggcaggacattctggaggaatcatgcccttggaaggatccctgaggagtgactgttgttagattaaaaaacagtggcaaagagcaatacagagagttgccaaaattcacaccgctggtccaggtttgaagcaagcaatctgtacctgcagtccttgtctgtaaccatggcaccctggcttctcacacatctcatcgtggagttccaccatgtgtcaggcatggcactgagcaccttcttttaagaatataatttgtaattatgtagattcttaattctacttcaaaatgccacacagccttcatgtgataaaatgaaacaattgctcaactgatctcctgggatctctactaagatgttggcagcccggccagctggtctggccctggacgtgccttcagggtctggttatgcttcatgacctgcattgtggtcagtgccattttgcagactttgatcacagtgaaacgttccacgggaacttgggccatgagaaacatccttcctaaccacgtgactgcagaaacatccttatcacatcctcctgggcaaaggcccaacagcctgactgcagggacatccttgccatatcctgctgggcagcaagctctaccacccagatccctccctcccagtcccatgattaccccagcctgtgagtggcagttggttctggcactaagctggtttcctcctccccagggttttgctggcaataaagatgttgctgttgaagccaccaacttgatggctgccagctctccaagtgtcacagttggtgaggcatccatggagagatcagcaagcagagagagcaaagggaacatgattaagggaaaagaggagcaataactcttccctttccaaacagattttcagaaatccaaaccagtgaattctgc

SEQ ID NO: 462154 - DNA, 1326 bp, Homo sapiens
agccctagactggaatctaggagaggggtggagccccttatgagctgtcaaccctacaaagtagagctagttattgatggtcaagcactgcttcctcccttcttcaacggcatctctagcatgtatacttcccttaaatccaccttcgtagcatttgctgatggaagaggcacaacagagtccatgccttcacctcctctggccaactctaatcatgaatctcctgtgaatcagctgggaaacatgcagaatatgagattggggccctcattcatactaactggaattttccttggcaatggtagaacagaagcttctccattctttacagatgaatttgctttaagtaagatcttcccagagtacaaaagaaatttattcggaaaatttcaaactaatatggccttctcactggaactggatccaccatcccttttgctcagtgtcgtcttgtttatgttttagatcctttgcaaggtgagctacacctctgagaggagctcctggaaattaccagatacttaatgttgccagctgttacagatggaggtgatgcaccttgatgatgcataagtactgagcctgaatcctacaaatgggaaaaggtgctcatatcagacttatgcattagatatcaaactacaaaatacaagtgcagttgatacctgtttagatgatgtagagcaaggtaacagagtatgtattaaaagcaaaaattcccatgaagctgaaccgttactctctgccaaaacctcccactctcaagttttaagagccaataaaccttgtatctgtacgttcagctttgccttttttttcccaggactgtaaacctctgtcaaggtttaccatgtttcattgattttattttttctagcaccaacataatgctcatatagtaatgaggatgaaataatttatttttttcctgctcatcgtgtcattgtgaatgttctgctatcatacaaaaaaaaccacactttatttaaaaatatttgctgagcaaatataaaccactgtgcatttttctgagcaccagtaagacagccaagtataaaggggtccccaaagaaactctgaccagcctgcacacttggaggagtgtacactggggtggagccttgggaagttcatgctgtttgcagtgggggaggagcctggcctctcctgatctggggtggtaaactgagattcaatctgtgaggcgggaagcatattagcaggactatttctttgctgagagtccctgtttccttttgtttccttttcacccaataaaccctgcccttctcacccttcaaagtgtctgtgagcctaatctttcac

SEQ ID NO: 462155 - DNA, 1390 bp, Homo sapiens
tgtttttgatatgcctgaaatggtgctaggactgggtgcctgcatcgccatggacaccaccaggtacagcaagtggggcggcagctccgaggaggtccccggagcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggctcctggagctgattgccaaagagttttttcttcctcatccaccgctgctgagtctcagaaacacttggcccaacatagccctgtccagcccagtgcctgggctctgggacctccatgccgacctcatcctaactccactcacgcagacccaacctaacctccactagctccaaaatccctgctcctgcgtccccgtgatatgcctccacttctctccctaaccaaggttaggtgactgaggactggagctgtttggttttctcgcattttccaccaaactggaagctgtttttgcagcctgaggaagcatcaataaatatttgagaaatgaatccaggatcctggctctggcgagatcttctgtgctttattccggatgtcctagtttaatccgtacgagtgacccctggactctctcagtgacctcttggcctttggtgggtaacttgccctgggccaggagggcttgaaggggaactctcatttataaaaccatcaga

SEQ ID NO: 462156 - DNA, 1960 bp, Homo sapiens
aggggaggactgggcactgcactgagtctgctgcccagagcctggcaccattgggctggctgaggcacactgccaagccagcaggtttgtgcaacagacttggctcccaaaagggaggcccagaaggcccagacaccctcaggaatagggcctggctgaagactgtgattaaggagaacataatgggatggtgagtgcagacgacacacacggcctcagtctatgggaacatctcaaaggagttcgtctgcaaattctagtgcatctaggcagaacacaggaaggaagagaggtgcagacttacgtatggccctggggcacctgccatcccctcgagcctgtatggtccttacccgcccatccccagcttgagttctgggccttctcgccagcacatcgttgggacctggtcaacttcagccaagttgctttggtttctattactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctga

SEQ ID NO: 462157 - DNA, 1774 bp, Homo sapiens
aggggaggactgggcactgcactgagtctgctgcccagagcctggcaccattgggctggctgaggcacactgccaagccagcaggtttgtgcaacagacttggctcccaaaagggaggcccagaaggcccagacaccctcaggaatagggcctggctgaagactgtgattaaggagaacataatgggatggtgagtgcagacgacacacacggcctcagtctatgggaacatctcaaaggagttcgtctgcaaattctagtgcatctaggcagaacacaggaaggaagagaggtgcagacttacgtatggccctggggcacctgccatcccctcgagcctgtatggtccttacccgcccatccccagcttgagttctgggccttctcgccagcacatcgttgggacctggtcaacttcagccaagttgctttggtttctattactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctga

SEQ ID NO: 462158 - DNA, 768 bp, Homo sapiens
gcttttcctgggcctaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgaagggttgatctgtgcagcaaaacactgtggcacacatttacctagttaacaaacctgcagatcctatactcataccctggaacttaaaataaaagttgaaggggctgggcacggcggctcacccttataatccaagcactttgggagggtgaggaggacagatggcttgaggtcaggagttcaagacctgcctggccaacatggtgaaatcccgtctctactaaaaatacaaacattagcttggtgtggtggtggatgcctgtaatcccagctactcgggaggctgaggcaggagaatcgcttgaaccactgcactgcagcctggctgacagagtgacactctatctcaaaaaaaaaaa

SEQ ID NO: 462159 - DNA, 857 bp, Homo sapiens
gagcatcatgaacgaccaagctggtatcaataattcgccaaaatgacgaacacaaagggaaagaggagaggcacccgatatatgttctctaggccttttagaaaacatggagttgttcctttggccacatatatgcgaatctataagaaagttgatattgtagacgtcaagggaatgggtactgttcaaaaaggaatgccccacaagtgttaccatggcaaaactggaagagtctacagtgttacccagcatgctgttggcattgttgtaaacaaacaagttaagggcaagattcttgccaagagaattaatgtgcgtattaagcacattaagcactctaagagccaagatagcttcctgaaacgcgtgaaggaaaatgatcagaaaaagaaagaagccaaagagaaaggtacctgggttcaactaaagcgccagcctgctccacccagagaagcacactttgtgagaaccagtgggaaggagcctgagctgctggaacctattccctgtgaattcatggcataataggtgttaaaaaaaataataataataaaggacctctgggctacaaaaaaaaaaaaaaaaaaaaaaagtattcttttgtaggctgactctgatagtttacttaaagcatatttgagaaagcttttcatttctacttccagttgctcaaatcatgtttcagaatttctaaatcatgtacatttgtttttgttctttttgtcccccccttaatcagagtctcatgctgtgatgcataaagtttacagtaattgaaaaagtaacgactaacacccaaggtggtaaataaatcaccaagttcactaattcaaagcactgaacatccatttgtagaa

SEQ ID NO: 462160 - DNA, 4243 bp, Homo sapiens
gaatttaaagtcagcagagattatctagactttactatgaaatatagacaagctgtgcttttaaaaggtttatttaaattactgattataaaagtaatccaagcccatttgtgaaaatttggaaaatgtggaagagtataaagaaaaaaaaaactactcattctatgagcaccgagagataaacgttatcatgttggcgcacttccttctggcctttttctccagatcagaggaagaggaagggtggtgtatcttcatgaaactactaacccaaacccagaacacagccatctcgctactaaagcacccaggaattgtagttttctgtgcaacagagattggggagctaaggctgaggattcagggtgaataacaagtctggtgcttgtctgcagaacagccagctgacttttgaagttgattcctccaacatgatgaagcgtatgtagctcaggaaaaacggcagctggccttaaatcatatagcataagcaaagggctcttccctggactatgtctcatttactatttgaataaacaaaattcaacaacctgaacaataaataaaataaaaagggaatctgctggatccactgaaaagtaatgcttacttattcaaatttattatgccccatttccccatgcattacatttaaacctctgattttttaaaagaataacatcattattgaaaactaatgttatgcttcaaagctctattacttgaactgttcataaatggatttatggctactgctgagttctgtgaaagactgtattgtatgccttctccttcagtttcaccaagactattaataaagatatccctacatcaacatttgccctcctgcagggagctagagccacttgacatccttgtacctcagtttctcattcataacactgggaacagtaattgtcccaacacctcagacttgttggatggatttgatgagctctttgatatacagctgttggatgtaggtgatatggagcaagccctccaaaattttcctgaaggagtactccatagtcactctactgccattataaacatttacctgaaattagtttcccacaaccaccaagctcctaaaaccgcctggacaaaggtcctaaggatcttcacacggcctggtatctccacgctgccaaacttattcagtctttgtatcttgacactgccaagtgactccatctttacattctaagacctcttttgctacatctgaagttcctgaccactcactcattctggaacctttctactttccccagcccctgagacacgactccctcttggtccaccccgattctcattctccagctccttggtgggctgctccttttctttgtgcccctccaacataggggatggatctgctttcatagttttaactactgcatacatctaataagaaccaagagtgtgtctctatctgaatctgtcaaatttgactcacaaacccaaggtgaactggacatcaccatttgtgtcttctacagacacatcaaacccaaaatgtccaaaagggaattgatcctgtccaccctcagtgtctattcttatattcctaatttcagatcacggaaccactgccagaaatctgtgggttatcttcaatgttccctctgtctcaccactcatacacttaaccggcatatggctgctaatttttttaagtatttggcaggttttctcccttctcctcattcttactaccactgccctagttcattccttatctcacttgaactttcacaaaaacctcttacctaatctctctgcctccacctccacattgccctcagagtggtctgcagagagcacaaagccgtccacatcactgaatgcgtcatgagctttccatcaatgattgcataaaaaccacgttctctgacatacatccagccaacttctttggcctcaccttctgcctatcatctccctgaatgtcatgtccacttggcatcatgtcacctatggtttcctatacaggctttccaattgctcaaagtgggtccagccgcaggcactccactcacacctcccaggttagcaggtgaactcctaccatcttccaaattcagctctggctttacctgcaagaagccttctttatcccacgtcacaagctgacctggtttagtgcttcctttcctcatccctcacctgcgctcctatggcaacccatggccaccttcctttgccacttcatttgcccgttcctacaaaacgtggctacttctcatcagtcccttgagggcgggaactgtgttctggttatcttcatgttctcaactgccacacagtaggactcattattaactgaactgagaacatttgtactaaattataagcaaaaagaaacaccccaaatacttaaagaagaacaatgcctggaatagttttgtacaaccagtattctgagataggtatcaatatggacatatatggtatactcatcctcccctggggagtaaagcagcaaacatagataaatcactcatcacaatattcgtttataaccatgaagaaaagcttgacataataaactatagatagtcttcatgcccattaggatggctactgtttctaaaaggtgttggcaatgatgcagagaaattggaacctttgtgcactgttgcttagactgtaaaatggttgtaaccacaatggaaaattgtacagaagcccctcaaaaaattaaatagaaccatcatgtaatccagcaatctcaattctggctatctatcctaaagaattgaaagcagggtctcagaaatatttgtacacccgtgttcatagccacactactcaagagtagccaagaggtggaagcaacgaagagttgttgtttgataggcagacagtttcagttttgcaagacgaaaagttctggaggtctgtttcaaaagccaaactgcccatatatttcttctctaaattggatcttaatctacatgagaaaatgcagaaccagtaaatacaaaaatcgagcattaaataaaattaagtatctcaaacgagaaagtgcctcagaggtggcctttcagcttcaaggacacatttttaaatttagcaaaaccctccattatatggtagaaaaagctgaagttctgactgcttagaatggcctatactttcttttatttagggatgtatagaattgttaagcataatcacaaaattaagctattattaaaatgcaaaaattgaattttggtgttgctccaagtcactgagctttcaccagcatttcgcacagcaaggcggatgcagctgactaaacaccacctcactggtctacacggcccctctgcacatgaataaatcttactagtaaatgcaagcaaaattaaaggcactttttcaatgacagcccgagaagctaaggaaataataagtgtggttattacaaaaccacagaggaatcataaaaatcaaacctccaaatactgtaaaggggaatgagttttttgaggagatagtaagctttttgaaagactgttatcttttcccttttgttaaagttttagacccaaacactgtaaaccgcgcaagaggaggctgtgtctgtgcacatgtgtgtgtgcacacaggggagggagggagatagacagagtgggtgtgccgagttgttaacagttgctggatccagacagaggaatacccaagtgttcattgctctgtactttcaacttttctgtttgaaagtttccgaaagaaaataattttgaagtgaaaaaacaaacagaaggggctcaatcagtgcttgtccaataaagtaaaaaactgttgttttttggttttggttttggctactaagtgaccatctagtggttgagtaagaggactacggaaacttcttatccaataagtgtttaagcttccacctccaggcactgtggtaggtgctgcagatgaagtgatgaacaggcctctgtcctgaccctaccgacccttggccaatgtggagcagatgacaccactggagatgccataaggcatttggatgggaggtgaggaggagctgtgtaaggaaggagaggaacatccatcttttcttggaggaggaggaagggggaaccaaggagcactcaaagatcacatcacaaccagtaaatatttgtgtaataaacgaacaaagtatatgcaagttgaatgatgtcttgaagcacccggctgaatctgtccacgtgtggggacagggtgaaacaatccaagcaaaaacagtagggac

SEQ ID NO: 462161 - DNA, 453 bp, Homo sapiens
gaatttaaagtcagcagagattatctagactttactatgaaatatagacaagctgtgcttttaaaaggtttatttaaattactgattataaaagtaatccaagcccatttgtgaaaatttggaaaatgtggaagagtataaagaaaaaaaaaactactcattctatgagcaccgagagataaacgttatcatgttggcgcacttccttctggcctttttctccagatcagaggaagaggaagggtggtgtatcttcatgaaactactaacccaaacccagaacacagccatctcgctactaaagtctcagagatattgagcttggacttcgaccatgggttctggagtccattcaattcccagccttggccattcctggctgtgtaatttcaaggaaattacctaaacactctgagttttgattctatcatcaataaaatgaaggaaatgcta

SEQ ID NO: 462162 - DNA, 264 bp, Homo sapiens
aagtaagtacgttgtgcgaccccccacccctttattatcagaggaagaggaagggtggtgtatcttcatgaaactactaacccaaacccagaacacagccatctcgctactaaagtctcagagatattgagcttggacttcgaccatgggttctggagtccattcaattcccagccttggccattcctggctgtgtaatttcaaggaaattacctaaacactctgagttttgattctatcatcaataaaatgaaggaaatgcta

SEQ ID NO: 462163 - DNA, 488 bp, Homo sapiens
gaatttaaagtcagcagagattatctagactttactatgaaatatagacaagctgtgcttttaaaaggtttatttaaattactgattataaaagtaatccaagcccatttgtgaaaatttggaaaatgtggaagagtataaagaaaaaaaaaactactcattctatgagcaccgagagataaacgttatcatgttggcgcacttccttctggcctttttctccagatcagaggaagaggaagggtggtgtatcttcatgaaactactaacccaaacccagaacacagccatctcgctactaaagtctcagagatattgagcttggacttcgaccatgggttctggagtccattcaattcccagccttggccattcctggctgtgtaatttcaaggaaattacctaaacactctgagttttgattctatcatcaataaaatgaaggaaatgctaaaaaaaaagagaggggaatggcctcgttggcctca

SEQ ID NO: 462164 - DNA, 1239 bp, Homo sapiens
ctctaccttgatcatggtggccacacaatgggatgtgtttgtctaaattcacggaaatgtacactttttaaaattttttttatttacttatttatttttttgagatggtgtcttgctctgttgcccaggctggagtgcagtggcaccatctcgggtcgctgcaacctctgcctcccaggttcaagcgatcctcctgcctcagcccccatagtagctgggattacaggcatgcgccaccacgcccagctaatttttgtatttttagtagagatggggtttcaccatgttggccaggctggtctcgaactcctgacctcaggtgatccacctgcttcggcattccaaagtgctgggattacaggcgtgagccaccccacccagccaaaactgtacactttaaaaggaagaattttactgtgtataaatgacatctcaatgaagttgatattaaaaacaccaaggctaggtgaggtggctcacgcttctgttcctagcactttgggaggctgaggcagcaggattgcttgagtccaggagttcctactgtgtctagccactgtgccaacccttccttgagttcccaattgggaaacttcccaatgaggaatttgatgcctacagaggttgagtgaccctgtccttaaaaaaaaatttttttttttaattagccaggaacggtggtgcgtgcctgtagtcccaggtactctggaggctgagtcaggaggatcgcttgagccttggaggtcgaggcttcagtgagctgggatcatgcccctatgctccagcctggggacaggttcccacgtgcacactgtaaggcacggtgaaaatcgggacattaacacggctgaatcgctaccatctaatccgaaggcccaaccacattcaccacttgtgccaataatatgttcatttcactgtatgttttgaaatgtgtaccacatgtatatgttatctttacgaaaaaaaaaatagtatgttgaaaccactcgtcacagccaaatgaaataagagctaactcattcaagcaggagccccggaggactaaaagaatccggcctctcccaggcctcctcacctgagcagggctccctcctgactaccgcccacccactccagggcaggacgcgggaagagactgcccagcccgagggtcgcaggggcagaaaaccccaggtcctgaacgcgcctgggccccgcggcgaacctggcgtccccaccagacaccagaatcagatt

SEQ ID NO: 462165 - DNA, 691 bp, Homo sapiens
gatgtgaggagcgcctctgctgggccgcaaccctgtctgggaggtgaggagcgtctctgcccggccgccccgttgagaaagtgaggaaaccctctgcctggcaaccgccccgtctgagaaccaggaacggtggtgcgtgcctgtagtcccaggtactctggaggctgagtcaggaggatcgcttgagccttggaggtcgaggcttcagtgagctgggatcatgcccctatgctccagcctggggacaggttcccacgtgcacactgtaaggcacggtgaaaatcgggacattaacacggctgaatcgctaccatctaatccgaaggcccaaccacattcaccacttgtgccaataatatgttcatttcactgtatgttttgaaatgtgtaccacatgtatatgttatctttacgaaaaaaaaaatagtatgttgaaaccactcgtcacagccaaatgaaataagagctaactcattcaagcaggagccccggaggactaaaagaatccggcctctcccaggcctcctcacctgagcagggctccctcctgactaccgcccacccactccagggcaggacgcgggaagagactgcccagcccgagggtcgcaggggcagaaaaccccaggtcctgaacgcgcctgggccccgcggcgaacctggcgtccccaccagacaccagaatcagatt

SEQ ID NO: 462166 - DNA, 509 bp, Homo sapiens
tgagaaaaaatcgcaaacatgttgcatctccaaatacctaactatgttttccacaaacagggacaggttcccacgtgcacactgtaaggcacggtgaaaatcgggacattaacacggctgaatcgctaccatctaatccgaaggcccaaccacattcaccacttgtgccaataatatgttcatttcactgtatgttttgaaatgtgtaccacatgtatatgttatctttacgaaaaaaaaaatagtatgttgaaaccactcgtcacagccaaatgaaataagagctaactcattcaagcaggagccccggaggactaaaagaatccggcctctcccaggcctcctcacctgagcagggctccctcctgactaccgcccacccactccagggcaggacgcgggaagagactgcccagcccgagggtcgcaggggcagaaaaccccaggtcctgaacgcgcctgggccccgcggcgaacctggcgtccccaccagacaccagaatcagatt

SEQ ID NO: 462167 - DNA, 1912 bp, Homo sapiens
tccatggccgcccccatgctggcattatttccccacctgaccatgaagaggctgaattcgatgttctctaagattttctccagctctgaggtgccacagtttgtgggagctgaatgcacatacacaaacctgaaagtaaccttcgaaaaatgcccccaaagaattatagagaattttgggatccatgtggtcctagccatcagtgaggtgcagagaagaaaccattgctcaactgcattacatccactgatagaacatacactgatacaatatatgccagacccatctgcaaatatacccacacacaacaatcctgcccgatacacaaattactgggagatgacaacccaacacacctacacacacaccaacacaccccaaacatcccctgcacacacaaatataacacaattcctgcactcttaaaaacgggcgggaggcagaggatcagaataagacgcagtggcatgactcttttcacaagctttttatgaacccacaaccaccaatcgaagtcttgattaacttggttgtatttattaaatcatgttcaatatttaataactttgaatatggattgaatatttaatgagattggtggagatctatttgtgtataaacgtcagaagtgccaattgctttgaattgagaattgagtctgtgactcattctcagtagctggtactggagagctctccattctacattttcatggatttatttaaattacaggttatcatcatgacattattacaccattacttattatgatgctccactattataacattattaggctgtcccagaaaatgtggcatttagatactgaatttccttgcatccagtaaaacctggattggggtctcttggtctccttcctccatgtttactaggaaaaggggccaaatatgacactgtgaaatgcatgctgtcttaagccctcaatcctcccacaggtacaagatgatctggaagcaatttctgggttatactttgtccaagactaatttgtccaaaagaagaaactctactttgtggactgaagacaagcaacatgaatttctgaaacttcttttacagaaatatgagaatcggatgcataatgcaattttcagaggcatcatggggattcgtgaaagtccttggaagatttgagattcaggaactcaatgaataaatttaactatccataagtgtggattttacacaagactttgagcatcatgaagacaggaaccatatgctattcatcgtcataccctcagctccttggcaaggtatctggaacacagagagaactctataaagatttgtcaagctgtactgaacaaccccaagcggatgcagattgggtcacaccaaatgtgactgctgattcatgtggtcatttggcaaatattgattgagtgcctatgatgtgccaagcactattcttagccaacgctaagccaaatacacaaaaataatgataaagtgagtgcttgtcaattaggtacaacccaggtattttaccaggctagttaattggtgtgttgagtcaatatgaagactgttttaaacttcagcttttgctataatattatttaagcctagacaggaaattcagggttccaataactcaatgctctctctttcctgggcttcagtgtccacacctacatgatgcacatatactgtagtctcccatgagatattttgacatatgtttatacaggatcctctgaaattccttgcacatttttaaatcttaacaatttgcctagaaacactttacaaattgcattaagtatttcaaggcttagaaaacactattgcacaaaatgcctttgtatttaagatctcatgataaagtccatgtatttatctcatgataaataaagtccaatcagctttcgattcagttgaaattcaa

SEQ ID NO: 462168 - DNA, 2705 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
  misc_feature (1307)..(1307): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggagctccacacagaacatcatcaaagaactgatggacacttcatctccctgggtgaggggcaggtgtaccatgctgtcatggccattcctgcctcgattggggtgtgggtgtagagatggtctctataaccagggcccagacatggctgagaaggccttctgccaggactccaccttgatgactcacaggactttgtgccttggctttccctattgagtgacccacagttttaatccaagggaccctgagtctgtttccttccttcagccccaccatttcaccccagcactgttcaggtgtacaatcggctttcacatatttgtaagaatatctaggaaaattatttatattttactttcacttcatgttatgaccatgagtgtttttgcatttgctagggctcattgttttaattggcccccctttatccctctgngtgcggaaataaatcagccctaaatctggatgagacctgcaggtggactccatcagtgcaggcgtggtggggcagcaggaggagcccgtggtgcccaccttccagagctgccacctcttttacctcctcatgttccttcctgtgcacctagagagagttcacccccacccaacagctcctggacctgctgcccaaaaggtaagtgctccatccctccacagcacaagggggactcagccacctattatctgtgtcttgggaaagtcccttcacatttgtgggcttcagtttgcttctttggaactggggttctaagaagcctaacatgatatgattgtttcaagaactaaatgagataagctatggaaagtacttcagacttggccttgtagaaagcactgctgagggaatagattggttattcatattataaaactatttaaaactctagaaaactatagtaagatataagattataaaaatatcaaaactaagatattgacagtaatagaattaacctactcatctatttgcattttaccagattaattttttcttatgtgtgtgtgttctgtgcaattttattacatgtgtaggttcacctaccagaagattaactcgttttcctcttataaccacatccgcttcccttctccccaccatacccactctgattctgattctttgaaaccattaatttctatttctgcaaatttgtcattccaataatgttatataaatgaaatcataacctgtgcaaccttttgtaattggcccttttccttcagcataattccttggagattcatctaaattggtttatgttttagtttgttccttttgttattgctgtgggttttcatgtgtggatgttaccatgaaatactgtgtgtaacccttcactctttcaagaacatatttgttgttttcagtcagtgtgtggctattatgaataaaagtgctatgtacattcatgtactaggtttcatatgaatacatgttttcattactctggaaaatatttccagcatacaattcctggctcatagggtagttacaagtttaattttaatagaaactagcactctgttatccagagtgactatcattttacattcccatcatcaatgaatttctgttttttcaaatcctcttagccatactgactgatatgtattgatatcacattgttttaatgtacatttttctaaaggataataatgttgaactttatttaatgttctcatatgacatctgcctattatctctgatgaaatgtttattcatgtctgcatgttttctaattgtatttgttttcttgcaagttttgagagttctgtttatattctggttactagctcacataggcaataaataagttttttttccacaaagaaa

SEQ ID NO: 462169 - DNA, 1341 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatgtggaaaagcgagattgtctttgaccatttgctatggacattgtcagggatggtgcagcctgaatgagaatgtctgcggtatttcccgaaataagtatccctcaaggatgatactgtggacctcactcaggaagaatgtgtccttcagggaaagctgcacagagacgtgatgctggagaagcagtcatctggttactttaggtggtttgtgccccaggaagtagtgtgttgatttgaagccctaaaaaaaatattttccacactcaagagtgacttatccagaccgattttacctaagaaacaagcctgaaggaggagagagaagaaagaagagtcagaactagcactttcccagcatgaatgagagatcctttcgcttcacgtctttgccagcatttggtgttgtcagtgttctagattttggccattatagtacatgacttcaggctcctatgtgcagaagtcctcaacccccaggctgcagaccagtacctgtccatggcctgttaggaaactggccgcacagcaggaggtgaaatgattattgcagtttcgaggggagatgatgtcacaagatctcgaacccatatctcagaac

SEQ ID NO: 462170 - DNA, 1461 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaactatcaacataaatttttgaaatctgtcttttgtaataaaaatcagataaattttaaccatgactcaagatattagtaaacatcatagtactcattttctagaaaactattacaattgtaatgaatgtgaaacaagtattttaccaatcctcaaagcttattttccctgaaaatatccatattcagaaaaagccttacaactctaatgaatgtggtgaaacttctgacccattctcaaagcttactcaacatcaaagaatttatattggagagagctcacaaagatgt

SEQ ID NO: 462171 - DNA, 361 bp, Homo sapiens
aaacacaaaattttgtatgtatgcaattcagctgagacactggggcagcgaactgtcttaaccatcaagagatcaaaaccagggcaggcacagtggctcccagcaccttggcaggctgagacaggaggaccacttgaggccccaggagttcatagtcctgggcaacatagtgtgaccctgtctctacagaatttttaaaaattagccaggcttggtggtatgtgcctatagtcccagctacttgagtagctgatagaggaggatggcttgagcccaggaggttgaggctggaggttgaggtggttgaagcttcagtgagctaattatcgtgcctctgcactccagcctgagtgatggagag

SEQ ID NO: 462172 - DNA, 1495 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggattttcaaattatagttcaaagaatgagtgtccaaccttttggcttccccgggtcacattggaagaagaaacattgtcttgggccacacataaaatacacgaacactaatgatagctgatgtgctaaaaagaaaaaaggttcatgcagttttcatgatattcgtcaccacagataagcaaaaagtcctctcattcaaagagctggttggacaccactgattaaaagtatctactcaccttctagattttttaaatgccctgtgtcattaatgagcttagaacattgctaagcaaatattaagccatctattatcttattttttaataactattatcttataattttgtcttatttagtagggagcctgctgggactgtgtcattgagatatatctatatgtataaatgtgtaaagtgatacacatacacatacctatataaatcgtatatgtgtatactcagttcttaatgttgatagttcttagaagctgtaactgtgaagtgtgtttcttgtaggcaacaaatcagtcttttttttttttatccatttagccactctatgtcttttgattggagagtttagtcgatttacattcagtgttgttattgattatataaagattt

SEQ ID NO: 462173 - DNA, 1334 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatgctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaactatcaacataaatttttgaaatctgtcttttgtaataaaaatcagataaattttaaccatgactcaagatattagtaaacatcatagtactcattttctagaaaactattacaattgtaatgaatgtgaaacaagtattttaccaatcctcaaagcttattttccctgaaaatatccatattcagaaaaagccttacaactctaatgaatgtggtgaaacttctgacccattctcaaagcttactcaacatcaaagaatttatattggagagagctcacaaagatgt

SEQ ID NO: 462174 - DNA, 1093 bp, Homo sapiens
  misc_feature (1)..(1): n is a, c, g, or t
  misc_feature (3)..(5): n is a, c, g, or t
  misc_feature (11)..(11): n is a, c, g, or t
  misc_feature (14)..(14): n is a, c, g, or t
ncnnngcctgnacnaggtactacccatacatacactacccacgaacaaagaaatgcgcgttgttctgtgctgcacatcaccattacagggatgtctccctgggaccaggcagtgtgactgggatgagccattcatcatcagggaagacacaggctacctgggtagtcatggtgtagaatgcctccagcacagtgcccagaagcccctgaatctgggaagaaagctacttccacatcagattggagccagtgctaactcaatcaacttccaattcctaaggcagcagaaagcccagctggagagggaaacttctgctctatctcaccctccctcattcatcctgggagccacattgtgttctgtagaatttgctcaggattcacaatctgagctgataaacttacctggattatcacacccagtatgtcacttgtctgggtccagtcctaggaaatcaatacctaaattcaaaaaatcatcctaagattaatctttgaaagctgcctggctctggggtgggaactgtccaatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatgtggaaaagcgagattgtctttgaccatttgctatggacattgtcagggatggtgcagcctgaatgagaatgtctgcggtatttcccgaaataagtatccctcaaggatgatactgtggacctcactcaggaagaatgtgtccttcagggaaagctgcacagagacgtgatgctggagaagcagtcatctggttactttaggtggccccaggagttcatagtcctgggcaacatagtgtgaccctgtctctacagaatttttaaaaattagccaggcttggtggtatgtgcctatagtcccagctacttgagtagctgatagaggaggatggcttgagcccaggaggttg

SEQ ID NO: 462175 - DNA, 1654 bp, Homo sapiens
aaatgctataccggttaaactccgccattttgcctcttagtgctcatgcttgagcccgcttgcccaactcctgagatgtcatcgggaagctgctgatcagcaattacagaaccagtggctttggttgggcactggaagtacataaagaagaagacatacatgctgtctcagggtgatcgtgggtctctagccaggagtcagatgacatcaccaccatcacaagctggtgatgccagagagcaagcagtcaccgtctatgaactagaaagctgattcaccagacaccgaatctgccagcaccttggtcttggacttcccagcctccagaactaggaaatgttccaacacatctgaggaaacacatgccttcccagactggcctgttgctgtttcccaggagctgcattctggaaggtggaccatcaggtggaagaagtattcttcagagagctgccttcccaagggaatggtgacagcttgcgcttgccggggagtcctgctgccttccgaggtgtgaagggaaggcatgcactgtgcatatgctgtaccatacagttttgcctacaactgcttgtagcttcattgtagctgtgaatgctccgttcctctccttttcacccctgaagattcgcgaacatgcaggattgagctgtgcgaggcatagcattccccacatggtagacgaaggcggatgtgggtctgatggctctactgccgtccacccgggaggatggacgtgtgttccgggatatcagagcttgcggctgaccagcccacatgtccatgcagccctcccgctggctgtgtcgacattttgggtgtcactgaaggattttactggtgcagactttacaaaggcaaaattgtttctcaaggaagtggacatgaaagatctaaaatcagggctgcttaaaaaaagcaagcacagattaatgacctatctacatcctacacggttttaggactgcgcctagatgggcttaaagaccctagcctaaaaactgtaaatgtgcttccgtctttgccctgtaggacaagaaagccttacgggcttgcttctaactgtgagaggaggagaggccaggaagggagagggagaaaaggaggagaacaggagacgagaaggaggggagagtgaggagaggaggagagaggcttgtcaaaatctttttagtgcacaaaactaattttgttcatcttggatttggtgagctgggtaatattctgtgcacggctcctaaatgaattattaaatgtcaactcaagatggcttaactaaaatactcaatttaataaccaaaagtatctaaggtaacaacaacaattttgcaggtgattgtagagttgtcaagtcaaaccattatagacaagcatttggggttttcacataatctccttccacatctcatcttctgtcactaaatacccactctgatcgagccagaaaaccttttttttttttctaaaatataaagcaaaacaagatctcagtcacaaccaccaaatctttattaatgcattccttgtgctacttctgaatattaataaaaattaataattaattttgcctttggcattgcaagatatactagttttaattagtgtactgtactcctatacaattaaaaaataattgatgtccatgcttattggc

SEQ ID NO: 462176 - DNA, 2571 bp, Homo sapiens
cgcctctccctccgggcggggcccctttcggtccaacggcaggacctgggggctgtggccgggggcggccgttgacctggtgaccgcggcgccgccccagaccgggggcgcagtcccactcgctccgagccccggtcccccaagcctccctcccgggtacctggggccgcgcccgccctgcgcccagctccgccctccgtcggcccaggcctgacagagcccggcagccatgagtgccaacccccggtgggacatcagcagggcgctgggggtggccaagctcttccacctggtgtgcggggtgcgggaagcctgcgtgaccccgttcctgaccctttacctgaggcagctgggcttggccgcgccctgggtgggcaccctaatgggaaccaagcacctaatcgctgccttctgggctcccgtctgtgccttcctggccaaaagctaccggaaaaggagagcgcttctgatcggctccctgctcggctcggtgggggccagcctgctgatggtcctggtcccaccggtagacaaaaatcgggtgcacttcccttgtaatggaagcagcggcctgaccagcacagacgcactcccgggggtcacgctacctgtgaacatcacctcggcccaagagtctgcctccagccacccagccaagaggactgcagaggtggaaatgcctggcttcagaaacccacctggtgaaagtgaccgagaaactttccgtgatctgcacgtctacttagcgccctccgttgaaggagctaggaccacatcccaagctctcctccatcctgtcacttcggggctgaaagatcatccctgggaagttacttttgaggtggtcaagacagccctccccttgcttcctggggggaaagggcccgggaatccagccaatttgtcagggaccaaggggaaagcctgggcttttgacctgtccttggaggcgttgcggcggacttttatcctctccttggggtccgtggcgttctgggagctgctgacagcgcctctggagcaggtggcagatgacagcctttatgagttcctggattttgtggatgccactgaccgatacagaagcctgtgggtctggaggttgctgggcatgtcggcaggcgtgtgtggcatcacagccttggtggggcagctggactgcttcctgatgaccagtggcccccgaggtgtggtccacttctatgggtactcggtggtcagcaccctggccttactggtgagcattgcctttcccattcccatctgtcagcagtgggagcccagctacaaaagggtcaaagcactgtccattgtggggggtgacccccacctcattctcctcgcctccaccactgttttggtaggagccatcgtcagtactgtccagaactttctgttctggcacatgaaggaccatgggagcggcgagctggtcatgggtttctcggtcgccctcagcttgctgggggaaattctgcttcatccgttcaaagctacattgcttaggaaactgtccaggacgggcctggtggggctggggctgagctgcctcgctgggcagctgctgtactactctttcctctggagctggtggtccgtcctccccattcagatcttgagtgccattagcaacagagctttgtggtgggctgtgggggcctcagtagaggacctggccactccccgcatggagagggctctgagtgccttgttccgaggccacttttacgggagtggctgtagcctgggcagctttgtcgggggcttcgtggtgatgcgcttcagcctggctgtgctctaccaggcctgctgtgtggccctgttgctctggttggccttgctcctgtccatacagcggaggctgccccgagagcggaaaatcaagtactcgaagctgctgtccatggaggtgctgttgaattcagcaatggctgaagcgatcaaatcaaactgtcagtgccaggaagaccatggggacctgcaggattcagttggcagagagggcagctgacttggatgaatcatggcattcccaggggtcataaaggcattagcctgcttctgtgaaagccatgctgtgggcagaagtcaggcctatatcaaaagctcaaagccccaaccttctaaatacatggttggtttttctggcatggccagcccccatcttgagtcattccattagcataaattgtgtaaggtcccatcatgagtcacctcattagcataaactcaagtgtggttgacaggccaaccaccagtaaaaaagacactcttcgacttggaaaattccaaggatttagagcctatctcccaggaactggggacaaaggccaaattctttattacacaggataattaatttgaaaatcagcaatgatcttaagtgcattaatagtttcttccttttcattgctgagtagtattccattgcatggatataccacgatttatccattcatttatattgtattatattaccatacatttcaattccaaacatgtaattgctttcagtttttgatgattacaaataaaacttttatgaatattcatatctaagtctttgtgtga

SEQ ID NO: 462177 - DNA, 4243 bp, Homo sapiens
ggggaatggagcagcctgtgcaccctgccaggttctgatctccacggtcccagctactgactggacgccatcacaaccttaccaatcttcagaatacactcctttccatccgacgaaatgatagaaccctctgaagactcatttgagacgatgatggagcataagaatccatcatcaaaacaaatggagtcctccgagggctcatccaacaccaccgaggcgacgtcgggcagtggagtgcggggagaggcagggccagccagcggcccagcccaggaaaagaaggagccccccagtggcccactccaggaaatggaagagctgcccactgatctactccaagacatggaggagccatccagtggcccacgtaaggaaatagaggatccacccaatgacctactccaagacctggaggagtcatgcaacggttcacaccaggcaaggggggatccactcagtggagcatctgataggatgaaagaagcatcagtcaacccatcgggagcccgagaagaacaagaggctcacactgacctgaaggaatcgggaagggaggagactcctcaagagcaaaaccagaccgagcactcaaccgcagaacttatggccatggtgaggtccatcatctcgctgtacttccgaatgcaagacctcaaagagcaacagagagtagcagaagagatcttgatcaaagggatcaatgcaggccaactgcccgccccaaagcacttctctggcgatcgcagagaattccacgagttcatcgtactctgccaactgaccttacagagctacccaagaatgttctataacgaccgtctgagagttggctatgtcatcaatcacctgtccggcttggcattagaatgggccaaagctctactgcaggaaaacagccccctgatcggagacttcccagccttcctggaggccatgtccgaagtgtttgagtaccgccaggcactgcgtgtggcagaagaggccatgttcaccatcaggcagggcggccgctctgccactgagtacatcgatgagttccagagcctggtacccatcttgggctggccagatgaagtcctgcaggcccacttgtgccaggggctcaacgaggagatcaggcactatctattccgggtccctcagccggattccctagacagtctgattgtgctcatcctgcaaatagaagagaagctggcagagagaagagctatgctcaggctgccccccgaggcccgcccccggaacctgacctggatcgactcacctgctccagagaggtggatggtcagcagctggttgcccagcgaagtccatccggacatcaatcgcgcccacctcttcctgctgctcatggtgagagtgaacccctaccacagcgtcgcggtccaggccctggtggattcgggagctgacggcaacttcatggatgagaagttcgcccaagagcactacgtcgagctctacgagaagccgtacccacagccggtccaatccgtggacggctcgctgattggcaacgagcctgtctggctctacacggagcccctggtgtgtatccaccagaaccaccaggagtccatcgaatttgacatcgtaccttcaccgaacttctctgtggtcctaggcatccgctggctccgagtccacgcccccgaagtcgactggatcaaaggccgctgcaccttccactctccctactgcctgaagaactgcttccgcccgcccccgccatgcattgccctagagaggcacggcatgagcctgctacccggactgccacacccatactcagacctggccgacgtgtttaacccgaaggaagcagatgatgagacttccgaccagccaagctcagacggatccgatgatctttctgaatcagagccctctgagcttcagcaggctggagacagtgatcacagcgagaccttttacgagtgtccctccaccgcgccttgggaacctgtgggtgccaggatgcaagaaagagccaggctacaggaggaatactgggacctgcaggacatgctgaccaacagacaggactacatacagatgattccggaactgtttgaccagttacacggagccgagtggttcacaaaactggagctgcgtgggaccattgtggaggaaagcgtgaacgggcaccgcaccgaagatgtgtggaaagcagcgtttggtttggagcttgaagagatgaagagctaccagccgtttgcgctctccccagaccctatcatacctcagaacgtgattcacttcatcctaaaggacatgctagggttctttgtgctttcttatggccaggaagtcctgatctactcaatgagtcaggaggagcacctccaccacgtccgccaagtcctggtccgcttccgccatcacaacgtctactgctccctggacaagagccagttccaccgccaaaccgtggaattcctgggcttcgtcgtcacccccaaaggggtgaaactgaacaagaacgtcatgaccatcataacagggtaccctacccctggctccaagctatctctgcgaaacttcatcgaattcgtcttcccctaccgccacttcgtggagcgcttcagcatcatcgcagagcccctggtgcggcagctgctgagctcctaccagttctactggggagtcgaggagcaagaggccttcgagtgcctgaagagggctttccgcaaggcgcctctcctccaccaccccaagccccagaacccattctacttggaaaccggcgtcaccggcacggccctgcacgcctccctgatccaaatcgacgaccaaaccggcaagagagcctgctgcgctttctactcccgcaacatctcccctatcgaggttgagtactctcaagcggagatgaagattcttccaatacgggctgccttcatggtgtggtgccgctacctggagaacaccgaggagcccatcatgatccttctcaacacagaggatctagcctctctgaataatgacaggctcaccgtacttctccccgggcattgggtcttcttcttctcccacttcaactttgacgtcatggagctgccagaacaagacggcggccgagctctgccacctgtgagaaacctccggtggaggagagccttccagaggaacactgccgccaggcaaaccctgctgctggcctcaaggggattccccagggatccatcgacggaatccggggaagaagagaatgaagaacaggatgagctcaatgaacagatcctacggcaagagctgctggccatgatacccatcgaccagatcctcaacagcttcctcgcccacttcagcatggcccagatcagggccgtcattctgcacttcttccgaggcctcctgtactggaagaacaccctagccctggcagccatcctcgtgctactgcgcgtgaggcaatgcctctcgctgcggccggcacccgccatgcgggtggctcggccccagccccagcgctccctacgactcatcctggattcgtccctcatcgcaggcagcagcatcacgacagccatcacccagctgctcacccagatgcccgctctcgtaggtgcaaacaccatcccagcccaggagctggctgagctgttcctgggccctggccgctggcagcgaaatgctctgcactcccaggcccaccgaggcctgcagttcacccctggcttctggctgacgctgtgtgagttcttcggtgtcagagtcaccccccaggagggccacctccctgccctgcgtcagaaccgctacctggagctgcacgtcgttggtgatgaggatgtcgtcttgcgagaagccctgcaagacgacctgcaacgttaccgtcagtgtggcctgcatgacggcctgcaagacacctcgcaggacaagcaggacaacgacgtgcaggaggccccacccagccacacagcagccacccacccaccccgcccacgccacctgatggatccccaggtcctggaattccttggtagccgcctgctccacatccacagtgcagatggccagctgcacctgctcagccgggagcaggcagccagggccctgagccagttcctgaccctgatctacaggcgggccctgcccatccccgcctgggagagccagcccagggagcaggcaaggctagaagagctgcctgatgaggacgaagatgctaacctcgactgaagacgcctccctgtctccagcaaagagtcccctctatttctcaccccaa

SEQ ID NO: 462178 - DNA, 1259 bp, Homo sapiens
gcgccttttaaatgaccccaggcgtggggtacatggtcccctgcaccacggcgtctgcggcacatggctcaacaactgaagccccaagaccaagtgtcctgctttgtgcggaagagtgcagggaggccgcatgaccccggtgttcgagtgccgcagcccaaatgaggaccacatctaccaggaggagatgctggagatggctcggaagggggtgctgcctgcggtgcccacagcctattcctgcctgcctggcaagcccaagagccagaagcacttccatgacgatatctttggtgctgtatttccctacgaggcaaagaaggacagggcggcggtgcagcccagcagcctggagatgtcagcgctctgagggcccacaggaggggttaaagctgccagcacagaacttaacgatggagccagctctgcattatccgaggtcacagggcctggggagatggaggaaagtgatatcccccagcctcacgtcttatttctcacctcgttccccatcaagccctttacttgacctcctaccaagtagcaccctggattgatcggagcctcctctctcaagctggggcctccctggtcccttggagacgaaatcttcaatgccaggcctggcaagtgggtgaaagatggaacccgctgctgagtgcaccacttcaagtgaccaccaggaagtgccgtcacaccactgtgtatttaactgccatgggtacaattatttatgcctctgtttaaaaaacgaacaccctagtctgttcctaatggccccttgggtcttctctgtatgattccctgatggagatatttacatgagttgaattttactttaatcacactgtatgtgtgtttgttgggtgggctggtgggggatgttttgtagggaatgtggccctcagttatagagtggggagctggtgggtgtcgcagcctggacagatgccccacagagggacaccccaggcaggccacggctcctctgaaatggctgccaggtgtgacagcagcagatggagcttcgtgctggtccaaagacctgcgcagcagcgtctcaggtggcaggagaaggtgcagtgccaacttcaggctccagacgtgccctgccctgcgtggcagccgtgcatctcagcaacacggccaggagtccgctccggaccagggcttccccgctttcatgtgcgggcctcatctggggtcccgtgaagacagagactctgatctcgcaggtggggtggggtgcgggatgctgc

SEQ ID NO: 462179 - DNA, 2632 bp, Homo sapiens
tgcccctaagtccataagccacagctacacagctgcccaaccattgagccctcataaactcccgtgttagagtttctgacctcagctgcagggagggtatggtatgtgtttcagactctgagcacctgtttgaggccgcgctaatcacccaggcttccgttaaccccacaaaacgcccacctaaccctgctgctctccctctggatccccgcaacccagctgtcccctcagagcccccggccctactgacagccaggctcgcattgctctccttcaaaaagccccccaaccccgctgacccgcccctcaaaagtcgccctcaccctcgccgcgagcaccctcccacttcggtgcccgcgcccctctcaaggccgagccgacgccccctcaccacggctcggggagcagcagccccaggttcccgggagcgccccgccctcgagggcacgcctccttccgggtcacgccctctgccccgcctccgaggcgggatcgcgcatgcgctgctctcctcgcgcggcttcccgcttccggctcccagctgctagctactgtggatctgggggggccggacggaggcatcggaggcggctgcgagagtggcagaggagctggcggagagcggcctgcgggcgatcgggccgaggagaggagaggaggggtcacttgggccccagcctctgctcctcattcaggagcgcccggggcaggaccagggatggaatggaacccaccacaatacccagcaccgtcgtatttcaggcctcccgggagaaccctcacaccccggagcagacagccctccctggcagggagcgtttgggtgcaaaaccgtgagaactatctgtgccatgggttttagtttcttgtataagaactcagttggtgctttcattgcggacgggaacgagaagctttcccctggtccttacatgtttcgttttgttttacgtttttaaatttcaacttttatttgagattgagggggtacatgtacagggagccagttagatgctcgaggggcttctcgggctgcgttctctgttgtcctgtaaataccgactgatctggataacagttgtcaagtcacaaaaaagagaaacacagttaggtagaaacccaaagcaaacccgctctgtgaggctgaggcaggaggatctctctctttttttttttttttttttgagatggagtctcgctctgtcacccaggctggagggcagtggctcaatctcggctcactgcaatctccgtctcccgggttcaagtgattctcctgcctcagcctccccagtaactgggattacaggcgcccaccaccacacccggctaatttttgtatttttagtagagatggggttttgccatgtctctattaaaaggccttttagatagatcgtggagctaatccgacctgaacatcccagtcctggagtattttagcatgaggatagctctctattggtctggaaggttcgcctgatggttgggcctgaagacaggggcctcagggactctcttgtagctccttcagatgggtgcttttgttttgaccaaaaacagaacattctataccgtgatccaatgggcacacgtacaataataggatgcaaagtgttaccaaaccgaactcacctttattgtgtgcgacagactcgggtgctttatttttatttttatttttttgagatggagtctcactcacccaggctggagtgtaatggcatgatcttggctcactgcaacctctgtgtactgagtttaagagattctcctgcctcagcctccccagtaactgggattataggtgcccgccactatgcccagcttattttttatatttttagtagacacgaggtttcaccatgtcagtcaggagttcgagaccagcctggccaacatggtgaaaaccccgtctctactaaaaatgcaaaaattagccgggtgtggtggcgggcacctgtaatcccagctactcaggaggctgaggcaggagaatcgctggaacccaagaggtgggggttgaagcgagccgagattgagccactgtaccccagcctgggtgacagagtgagactgagtctcaaaaaaaaaaaaaaagaaaccaacctctttgctacttgtttgtggcctgtttgctcccagcatgggcaatttcaagcgtctggaattcagtaatgactttgcacagcgaatccactttgccactccttttattccggttccttctgcacatcagggatagagcattgggagttcccagactgcatgagcccagctggttgcatttgaattcttggaaataggctctcccttccagaacaaaccaattagatatagtaggccaggggccagcaaattttttctgttaagagctaggtagaggccgagacgggcggatcacgaggtcaggagattaagaccatcttgactaaaacggtgaaaccccgtctctactgaaaatacaaaaaaactagccgggcgtggtggccgcgcctggagtcccagctactcgggaggctgaggcaggagaatggcgtgaacccaggaggcggagcttgcagtgagccgagaccgcgccactgcactccagcctgggcaacagagcgagactccgtctcaaaaaaaaaaa

SEQ ID NO: 462180 - DNA, 504 bp, Homo sapiens
tttttttttttttgagacagagtctcgctctgttgcccaggctgaagagcaatggcgcgatcttggctcactgcaacctctgtctcccgggatcaagcgatgctcctgctgtagtctcccaagtagctgggattacaggcgtgagccaccgcgcccagcgacctcttccaacttctaaaaggtggccctagggattcctcggcttgtagccatgtcattccacaccctccgtggtcacgtggccttcacctgtgtgtgtgtttcccctctgtatctgtgtctctaaatctccctctcctttctctacacagacaccagtcataggctctagggcccaccctaaatcgaaatttcatcccgagatccttaactaatgacctctgccccaggctctctttccaaagaagtccatattccagggttcttagtggacgtgaattttggtgggacactgttcagcccacttcaggacctcctattatctagcgagtttgtaaacaacaa

SEQ ID NO: 462181 - DNA, 904 bp, Homo sapiens
gagacggtcttgctctgttgcccaggatagaggaagcacagctcactgaagccttgacgtcctgggcgcaagcaatcctcccgctttgtcctcctaagtagctggcactacaggtgtgcgccaccgtgcccggctaattttttattttttgtagagatgaagcctggccaacatggtgaaaaccccgtctctactaaaaatgcaaaaattagccgggtgtggtggcgggcacctgtaatcccagctactcaggaggctgaggcaggagaatcgctggaacccaagaggtgggggttgaagcgagccgagattgagccactgtaccccagcctgggtgacagagtgagactgagtctcaaaaaaaaaaaaaaagaaaccaacctctttgctacttgtttgtggcctgtttgctcccagcatgggcaatttcaagcgtctggaattcagtaatgactttgcacagcgaatccactttgccactccttttattccggttccttctgcacatcagggatagagcattgggagttcccagactgcatgagcccagctggttgcatttgaattcttggaaataggctctcccttccagaacaaaccaattagatatagtaggccaggggccagcaaattttttctgttaagagctaggtagaggccgagacgggcggatcacgaggtcaggagattaagaccatcttgactaaaacggtgaaaccccgtctctactgaaaatacaaaaaaactagccgggcgtggtggccgcgcctggagtcccagctactcgggaggctgaggcaggagaatggcgtgaacccaggaggcggagcttgcagtgagccgagaccgcgccactgcactccagcctgggcaacagagcgagactccgtctcaaaaaaaaaaa

SEQ ID NO: 462182 - DNA, 682 bp, Homo sapiens
atgggcacacgtacaataataggatgcaaagtgttaccaaaccgaactcacctttattgtgtgcgacagactcgggtgctttatttttatttttatttttttgagatggagtctcactcacccaggctggagtgtaatggcatgatcttggctcactgcaacctctgtgtactgagtttaagagattctcctgcctcagcctccccagtaactgggattataggtgcccgccactatgcccagcttattttttatatttttagtagacacgaggtttcaccatgtcagtcaggctggtctcaaactcctgacctcaggcaatccgcccgcctcagcctcccaaagtgcctgggattacaggcgtgagccaccgcgcccagcgacctcttccaacttctaaaaggtggccctagggattcctcggcttgtagccatgtcattccacaccctccgtggtcacgtggccttcacctgtgtgtgtgtttcccctctgtatctgtgtctctaaatctccctctcctttctctacacagacaccagtcataggctctagggcccaccctaaatcgaaatttcatcccgagatccttaactaatgacctctgccccaggctctctttccaaagaagtccatattccagggttcttagtggacgtgaattttggtgggacactgttcagc

SEQ ID NO: 462183 - DNA, 3029 bp, Homo sapiens
agctctaagtcgattacttcgggcacctcctgaggctcagagaaatggctaaagacactctcggaaggaatggagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggcggaaagccaggacctccggcatgtcatcattcccttgctgcacactgtaatgtacgtgctcaccaaggccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggccagccctcgccgcaccctggagcactatttccacgccgtggtggccgccttggagcagatggccagcgaggccagcccgagccgggagggacacgtagagaggctggaggagatttactgctcgctgctgggtcccgcggcggggcgctgcggtggtgaccttgtccaagagcggccaccaagcattcccctgcccagcccctacatcaccttccacttgtggaccgggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatggtaggggagggctcgtactttggaccagaccaccgtggaaaagacgaagtaaaatattccttccctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagcgacacagaaggtgaggaatggggaatgcagagcaaagaaagagagaagagatgagaagggcaatgctggggagagggcagagtggcaggagaagggggagccctctcagtcacggaactggagccaggaccaggacttggtgactgccttcaagttgcttgctccctactctagaccctatcagaaccagtctgatgatgccagcaccctcgtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcaggcccaggaggaaggatacactaccccaccaactccaaacactcacaccaacagccagagcaaggcccggctccacacggcagctttggccttgaccaggagccagcgagtgcctgggagcacagggagcctaccctggggactgtgatgaggaagggcccacatggaggtctacggatggcccaggcaatgctgtcgctgcttgagaacatacacaccaagcccagcttctcatacaaatgtctactccttcatttagcttcaattcccacttctcccactgtcctctcccacccaagctccccatccagcccttaaaaccagggtgagagaaaaatgtcagactcaataaatgtacactgaagtctttctgctttcatctcatacctggcaatatttatatgttaataggaatcatcagggcagtcctttttataacctattgagtccacttgggccagagattaaagacaccaaaattcttggcttttatgttcaaaaacttacatccaagtgtaaaatagaaagatcaatgacacatcttcagtttcttcatccccagaaataggtatggtgtggggggagag

SEQ ID NO: 462184 - DNA, 2493 bp, Homo sapiens
agctctaagtcgattacttcgggcacctcctgaggctcagagaaatggctaaagacactctcggaaggaatggagatgtggagctggacctccagaggagcgtgcaggctgtgctccgggagctcagcacccaggcccctgccctgcagagcaaccaaggcatgtggaggtggtccctgcacaagaaggtcgagcgagatcccggtaagagcccagtgctggtccgcattcttctcagagaactggagaaggcggaaagccaggacctccggcatgtcatcattcccttgctgcacactgtaatgtacgtgctcaccaaggccacaggaatcacagaagagctctaccagagaatctatgccttttgcacaaggttactgaccctgcccaccccctactgcacagtcgccttggactgcgcgataaggctgaaaacggagatggctgtcccagggacactgtaccaaaggatggtcattgccgaacagaacttgacgaatgagctgtatccctaccaggagagagtgttcctcttcgtggatcctgagctggtgtctgcgtctgtgtgcagtgctctgctactggagatcgaggcggcccaggcgcagcagacaccagagacctgcatgcgccacgtggtctcccacgccctgcaggcggctctgggggaggcctgtcacgcaggcgctctgcacaggaagctgcaggccagccctcgccgcaccctggagcactatttccacgccgtggtggccgccttggagcagatggccagcgaggccagcccgagccgggagggacacgtagagaggctggaggagatttactgctcgctgctgggtcccgcggcggggcgctgcggtggtgaccttgtccaagagcggccaccaagcattcccctgcccagcccctacatcaccttccacttgtggaccgggaaggaactggtgctcttcctccgcccaagatcccagctgcgcctcagtgctgacttggaggtcttggatctgcagggcctccggccggaccgggagttggcccgggtttctgtgctgtccactgacagcggcattgagcgggaccttcccacgggggctgatgagctgcctgcacccggcagccctgagatggagcgagccgggctgcagcgcaaagggggcatcaagaagcgtgcatggcccctggacttcttgatgcctggcagctgggacgggcccccagggctgcaccggaggacaggccggcccagtggggatggggaaatgctgcccggcgtgtcccggctgcacacagcccgggtacttgtgctcggagatgacaggatgctggggcgcctggcccaggcctaccacagactcaggaaacgggagacccagaagttctgcctcactcccagactcagcctgcagctctactacatccccgtgctggcgcctgagaagcctgcagcatccaggcagccggagctgggagagctggctacgttcctgggccgcgtagacccgtggtaccagagcaacgtcaacacgctgtgccccgccatccacaagctggctgagatggtaggggagggctcgtactttggaccagaccaccgtggaaaagacgaagtaaaatattccttccctccttccctggacacatcccggactgtggaccccttcatcctagacgtcatcacctactacatccgcatgggcacccaacccatctatttccagatctacacagtcaagatctttttcagtgacctgagccaagaccctactgaggacattttcctcattgaactgaaggtgaagatccaagattctaaattccccaaagcgacacagaaggtgaggaatggggaatgcagagcaaagaaagagagaagagatgagaagggcaatgctggggagagggcagagtggcaggagaagggggagccctctcagtcacggaactggagccaggaccaggacttggtgactgccttcaagttgcttgctccctactctagaccctatcagaaccagtctgatgatgccagcaccctcgtttcagggtctagccattgccccctgcctgctgctcctgtcacagaccacacatgtctgaatgtcaacgtgacagaggttgtcaagtcctccaacttggcgggaaagtccttctctacagtgaccaacaccttcaggacgaacaatatccagatccagagccgggaccagaggctgctgacactgtcgctggacaaggacgatcaacgcactttcagggatgtggtcagattcgaggttgctccctgcccagaaccatgttctggggcccagaagtccaaggcaccgtggctcaatttgcatgggcaacaggaggtggaagcaatcaaagccaagcccaagccccttctgatgcccatcaacacattctctggtattgtccagtgagcctgcagggacagcagcaggaggaggacagcagcaggaggaggacagcagcaggaggaggtacgag

SEQ ID NO: 462185 - DNA, 572 bp, Homo sapiens
catttgatgctgccagttttattattgttattatgctcattaatattaatactcagccactgtacctatttaagattgaagaggagaaaggcaaggttttgctgaaatcatgatagcaggtgcagggggaagaaagtagcccctactccaccccccggcctcaatctcccgctaacaacagttacagcaccagccttctgcaatcccttccatcatcctcagctgcacagagaccccctgcaacttcctctccaggtggctgtaaatctgggacctagcagtgacaatgggtttggggcgggtgggcatgaggggcttgaaggctccttgaagcgaccttcctagttataatatttgaaaatgtagaataatttatgggtcagattgccaatggttccttctcctttctaaaaaccaattctgaatttgcttcaccatatttttgatgatgtgttttatggcctcacaaactcccagctggttccctcgatgatctcgtctctgtggttactgtcaacaatccacattcgtgttgtggcatatcatcttacagaagcatttaaagcagctca

SEQ ID NO: 462186 - DNA, 3457 bp, Homo sapiens
tttaatgccaaaatctctctcactggcaggacacatcgggtaaatatttctactgcaggagaccacattcatttgatgctgccagttttattattgttattatgctcattaatattaatactcagccactgtacctatttaagattgaagaggagaaaggcaaggttttgctgaaatcatgatagcagtgacaatgggtttggggcgggtgggcatgaggggcttgaaggctccttgaagcgaccttcctagttataatatttgaaaatgtagaataatttatgggtcagattgccaatggttccttctcctttctaaaaaccaattctgaatttgcttcaccatatttttgatgatgtgttttatggcctcacaaactcccagctggttccctcgatgatctcgtctctgtggttactgtcaacaatccacattcgtgttgtggcatatcatcttacagaagcatttaaagcagctcagggcttctttcctctgatgtagattttctccattgttactcaacgaggctctgacatcagcctcctttcagttcaaaagacaggacgtttttctgggagtcaggaactgaatgcagaacttcccgcgggcttcacaaaggaccgccgaaagggacagtcacacactgccatggatgtggtctcctctctgaggagctgggaataacgctgccctcccacaggcgctgctcccaggaggggcgggaaagcatgatgccaaagggcagtttcaaaactgggccccggggagcagcagcgttaggtgtggacaacatgaaaaagcacctaagacccagtgctgtcctgcaatgagacagagacgcggccactgtcccgcacagccccacgggcagaggaggcgctccagaggagggactttgagagacgacgcaatgtgcctgctgtgggaagtcacaagacagctgctattcccgggccgtcagggccaggccagcctggctagctgctgagagggtctgcacagtgactccatgaggttagcaaaatatatatatttttaaagcctagcaacctttcctaaacatttttttttaatcaccaaaacatcacattgtaaggagtttcagattattcccaacatttcccaatgtcaagtcttggacaacatgtctgcaccaaacatgtgcttctaaatagaaaaccgaaagtccctgtcaatcaggaaggtaacactctggagaggaggaggaaaggaagtgagacagtgctggtgtcttttgtcattaggacagtggagatgcggctgcttgacccaagcagcatactggaaggacagctgagagcaaaaacggaaagggagcgtggaggttttcacagcaggacgtgtgtgggcagaaggattctccagtgtccacagcaggatacgtgtgtggagatggattctccagtgtccacggctggacgtgtgtggcaaaaaggattctccagtgtccacggcgggacatgtgtggagatggattctccggtgtccatggcaggacgtgtgcggcgagaaggattctccagtatccacagcaggacgtgtgtgagtagaaggattctccagtgtccacggcaggatgtgtgtggcgagaaggattctccagtgtccacggtgggaagtgtgtggcgagaaggattctccagtgtccacggcgggacgtgtgtggcaagaaggattctccagtatccacggcgggacgtgttgtccacggcaggacgtgtgtggcaaggattctccagtatccacggcgggacgtgtgtgagtagaaggattctccagtgtccacgaaaggacatgtgtggcgagaaggattctccagtgtccacggtgggaagtgtgtggcgagaaggattctccagtatccacagcgggatgtgtgatgtgtatggcgagaaggattctccggtgtccacggcaggacgtgtgtggcaagaaggattctccagtgtccacggcgggacgtgtgtggagatggattctccagtgtccacagcaggacatgtatggcgagaaggattctccggtgtccacggtgggacgtgtgtggcgagaaggattctccagtgtccacggcgggacgtgtgtggcgagaaggattctccagtgtctacggctggggacatgtgtggggaggattctccagtgtccacggcgggacgtgtgtggggagaaggattctccagtgtccacggcgggatgtgtgtgggcagaaggattctccagtgtccacagtgggacacgtgtggcaagaaggattctccagtgtccacagcaggacgtgtgtggggaaaaggattctccagtgtccacagtgggacacgtgtggcaagaaggattctccagtgtccacagcaggacgtgtgtggggagaaggattctccagtgtccacagtgggacgtgtgtggcgagaaggattctccagtgtccacagtgggacacgtgtgtcaagaaggattctccagtgtccacggcgggacgtgtgtgtggaaaaggattctccagtgtccacggcgggatgtgtgtggcgagaaggattctccagtgtctatggctggggacgtatgtggggaggattctcagtgtccacggcgggatgtgtgtggggagaaggattctccagtgtccacggcaggacatgtgtgtgggcagaaggattctccagtgtccacagtgggacgtgtgtgtggaaaaggattctccagtgtccacggcaggacgtgtgtgtggagaaggattctccagtgtccacggcaggacgtgtgtgtggagaaggattctccagtgtccacagagggacgtgtgtggcgagaaggattctccagtgtccacggcaggacttgtgtgggcagaaggattctccagtgtccacagcaggacgtgtatggcgagaaggattctccagtgtccatggcgagacatgtgtggagaaggattctccagtgtccacggcaggacttgtgtgggcagaaggattctccagtgtccacagcaggacgtgtatggcgagaaggattctccagtgtccatggcgggacgtgtgtgggcagaaggattctccagtgtccacagtgggacacgtgtggcaagagggattctccagtgtccacggcgggacgtgtgtgggaagaaggattctctggtgtcgttttcgctggctcctcactcccagctaacaaagtgtttcttcccattgtagctttggctttcagaagtcagccttctttcctccccaaagggagggctttcctcacataaaagaaaattaaggctcccccatatgtgttttgacctggtattatggcatgaaagccacttgcaccttcttacaaagtcttagtgaactacttctgaaaaatggtaataattaaaaagggttaaaaatacacagtagtcagccttttaaaaacattacaagactgacacagcaggcatgtg

SEQ ID NO: 462187 - DNA, 1370 bp, Homo sapiens
gctccagaagtgcctgcaggaaggaatgaaaggacacaggggcgagcgagtctctgagtatgagaagatcgttgacagccctggagcagcaagggtgctctggtgtgcggcttccacccttcccctgatcgcagctgcctctgttgggctagctcctccaaccatagtgcttgatctatttccatttccccgaaccatcgcttggatgatgaagcacatcgcagagtactgcttcatcaccattcaggaattgtacccttttaaatttctatatggaggatttcaacatacagccaagcaacccaaagtgatttctgtatttttcaatccagcccaagagtggattggcaggaagggtgcaggacctaacccaatgacaatgctcgcaggaggagccctccagaaggcaacagccccacaggcctcctcactcagaagtctttgaaggacgcatgtcaagcacaggatgtgtgctttttcctactgtaaacaagcaagtctctaaaaatattcatgagatttttctacgagggaaaaagaataatattccactgaactgaagaccacatatgaaacaggggaaggacgctggaaataaagctccatacatagctcagtactagtagatcagcatgttaactaggttaattcccaactgtcctaccaccaactacctagcacgaggctctcaacaacctgcagccagatcccaggtggtcccaatggctacattcattgaatacagcctgagcaatactctcactccactcttcactcagctgaccctgtattctgtgaattctgccctagctccaaacctcttggtacaaaggaactctctacgtttagttctctcgacaactacctactataagatgaagtttccaggaactcatgtgatcatgagactctgcagtcacttcagggggtcttgttgactggctcggggggctggtgtcaagcccaagcagaagagccctcagagcaagcagccctgcttctgtggattctggatggcatcatcaccaggcgggtccttcagagtactgggagcagcatgcagcccgatagagttggcaaacgtgaatctactagaagattgacatggagatcgacaacaggatggtggacctcatggcccacacggcctctaaggaataagacccccagaccactagccccagcaaaaacacaagaggaagagagaggccctcagctgctggtgagtccctgacgtgtccagttccctgccacactgagaatctcccctccccgcaatttccatgcagaccccctgaaaagggaagggccttggaagccccaccttgtcatctaccatcaataaagtcccctatgctcagccaaaaaaa

SEQ ID NO: 462188 - DNA, 1049 bp, Homo sapiens
aggtagtggtctatcaccatcttcagacctctccttgaagtccctggcatcccagtcatgcctccccccggggaaagggctctcccacagcctccagggcaagaagcccgcagccccctgtctgcccaaagcagaagcagcacagttttcagcccctgcggctccaggcacacccgagatgctgtgtggacccagccagcctggtgcctgccctgggccttcagactgcccctcccgcattgccacactgccacccactccagcaccggtaatgttcacagcttccctggggaaagggctcccccattttcttgaggaagaatccacttcctcctttccccaagtctctgaatccttctctttcttcccccaaccataccagcacacctatgtcccggctcggaccacagccccggagactctgagtgtgggctccctggagacatggctgtggtcacagcaggatttaagcacagacaggtggggtccagagtccctgcgcttaaccactaatctctgctgctctctggaacctctcgtgtgggtggtgggcagccatgagaacaggggaaatgagaagagaccaggccccgccctccacagcaaccccaaagtgtctgccctctcacctcatcacagagctgccagtaccaaggagtttgggagaggggacagttgcacccgcaaaagagaaggaggagatctgaagagcacagtcaagaccacagacacccgtggaggctcccccaagacatctgcttctctgggactggggacctcgctcaggaccgtggggagttggctgaaggacttggggagcccagaagctgccaccgaaccaagccctcttacttcagtcttctcctctatccaggaggtcacccccactttatctcacaccaacaacagggagcagcagctgtgaacaggtggtccccatttgcttctttttgccgtgtccatagaaggcttctatggttctgtggtgtgactttctgtggttggagaggcaatatgtgacaaaggtaagggctctagacctggaatct

SEQ ID NO: 462189 - DNA, 1514 bp, Homo sapiens
tctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggacccagtggcctttgaggatgtggctgtgaacttcacccaggaggagtgggccttgttgaatcctttccagaagatctctacagagatgtgatgcaggaaaccttcacgaacctcatctgtatagaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagagaagccgtacaaatgtaaggaatgtgggaaagccttcaattgtcccagttcttttcacaggcatgaaaggactcacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactgagtcaaaacctggtaccacaggacagagcagcaatgagtgaccaacccctgactctatgtgcagatgacacatccatccccagattaggtatcaacataagtgaaagtgataatccttgatagtacctgttgtcccaacatagtttttcatagcacctcatct

SEQ ID NO: 462190 - DNA, 349 bp, Homo sapiens
tctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatgttaaagagtttgttggagcaacagcgattccgagtgagaaacacccggtcatggcttgtgattgaagaaaaggcttttataagttgcatgaggaggcaaacaggattaaatacttgattagttacagtgatgctgtcgccgtatgtggacttgtcaacctgaaataaaagaatcagattcca

SEQ ID NO: 462191 - DNA, 370 bp, Homo sapiens
gtaaagtgcccggcctagcgtccagatacgtggaagaggggctgggtggaaccaacaggatcctgctgtggcgggacccaggcctccgctcgggcgaccccggcgattgggacccgcgtcccccatggcgtggcttggccctcggtccgctcggccgccaggtggggctgggcccgcagctgggaccccgggcgtcctgtcccgtccctacgcggcgactgcggccccggccccggagtcctctctgggcagctccgcgcccgcagcccggcgtcttcccagattgtgcgggggccacgggagggtcatggggggtcggatgtgtcccgcctttcttctgctaaaaattaaactgaggctctgttaacag

SEQ ID NO: 462192 - DNA, 2191 bp, Homo sapiens
aggctttgcagtggctgcttggcttggcagtggtcgcttggcttggcgtggcagtgatcgcttggcttggcatttctggcttagcggtcctcctttcgcagattggaaaccgcgggctatcctgctgggaggttgtggccgaggcagtagctcgctactgatggtctcctggggtggagaaaagcggggaggggctgaggggtctccgaagccggcagtctacgccacgaggaaaaccggtagcgtcaggagccaggaggaccagtggtacttgggctacccgggggaccagtggtcctcgggcttctcctacagctggtggaaaaacagcgtcggcagcgagagcaagcacggtgagggcgccttagaccagccccagcacgatgtccgcctggaagatcttggcgagctccacagagctgcccggtcgggcgacgtccctggggtggagcacgtcttggttcctggagacactggcgtggacaagagggataggaagaagagcattcagcaactagttcctgaatataaggaaaaacagacacctgaaagtcttcctcaaaataacaatccagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggggttgtacttctctcagggaatgatactctccatgacctgtgccaatcacagctaccagaaaacaaagagagcaaagaagagaagacacccaagaaacaaaacaagcaaattaatcttccacttttgcatctgcagaaaacgtctcaagaaccagaaatggctaaggattgtgatagagaggatatacctatatatccagtacttcctcatgtgcaaaaatctgaggaaatgcggattgaacaaggcaaattagagtggaaaaaccaattaaaactcgtcataaatgagttaaagcagaggtttggtgaaatttatgaaaaatacaaaattccggcttgtcctgaggaagagccactacttgataactctacaagaggaacagatgtgaaggatattccctttaatttgacaaataacatacctggttgtgaggaagaagatgcatctgaaatatctgtctcagtggtattcgagacatttcctgaacaaaaagaacccagtctcaaaaatatcatccattcatactaccatccgtactctgggtcccaggaacatgtttgccagtcatcttctaagcttcatttacatgaaaataaattagactgcgacaatgataacaaaccaggcattggacatatttttagtacagataagaactttcataatgatgcaagcactaagaaagcaaggaacccagaagtggttacggttgaaatgaaagaagaccaagagtttgatttgcaaatgacaaaaaatatgaaccaaaatagtgacagtggcagtacaaataactataaaagcctgaaacctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggtaagcctatagcagcgtttaacaggagacaattggtcaagtgtggtggctcacgcctgtaatccagcaatttgggaggccaaggtgggtgaatcacctgaggtcaggagttcaagaccagcctgaccaacatggataaaccccatctctactaaaaatacaaaattagccaggtgtagtggtgcatgcctgtaatcccagttactcaggaggctgaggcaagagaatcgtttgaacctgggaggcgggggttgtggtgagccatgatcatgccattgcactcgagcctgggcaacaagagtaaaactccatttcaaaaaaaaaaaaaaaagca

SEQ ID NO: 462193 - DNA, 2683 bp, Homo sapiens
  misc_feature (10)..(10): n is a, c, g, or t
ttccctgttncaggcatgtgcttggtacagcctcttcccccaaagctaacatcctcactagaatgtaagcttcatggaggcagggggtttcgttcattgcactactcccagtgcttggaatggtgcctgggactctataagtgctttagatgggtgtctcgctgtgttatccaggctgatctcaaactcctggcttcaagtgatcctcccatattggcctcccaaagtgctgggattacaggtgtgagccacggcaccctgccgaatctttgagtctggacaccagtaggtggtcatggtccagttccttgcccagatgcccacagggacttccagcttccaggctgcaatcacagagaatgaagaaggaaggctgttcgagaaatatgggcagctcttacaggaaagccccccagcctctaacaggccctctctgggcatcgaaggtgccagtggtcttccaaggcccgggatgtgccctggacgtgattgctctcctgggtcttgtcttgctgctctttgcccccgccctcctcctctctacctgatggtgccaggtaaggcttcaggcatggcagaggctgaactgagagccaccctaccttgttcctgtggctccatccccctatccacacccaagagatgagatcctggggcagttggcatctgacagcctggcatcgactcatgccaacagcttggaagctgcagtaattagaaggggagagggagagagggggagagaaggagagcgaaagcaagctctagagagaaaccttctcctgcctgccgcagggcaaactacttcaaacgaattcgtttcgctcttgtgaaactgaagacaatttccttttctgtcataaaacaaattattgctcatcaggagtgctgggctagtctctttcctaagggtgtgctcttgctcttgtgcaggaggaggggaaacattaggggaggggacccagggtgcaaaagggatttccgggagccatcctgagggggagtaggaagagaagctttggatagattcatgctcctctcaggagtgaaacggcgccgtgtcccccttgtcaacctccccgactgaccagggaaagtgtccaagaaggtaccgcttggctccaaccaccaggaccgaaagagcctctgagagggtccaaccctcctccatcctcctgcctccaagccaccctggggaaggctccacctcccccctcaggcacctgttcctgctgttgaggggtgtaattagccctggcagatgaaagggcgtctttgaaagcagcaaataggtaaacaagtggttgaaaaataggaaaaggggaagaaaaaaagagaagctatcatggggtgttttctcccaggtatcagggtcgcaggtagttccaacctcaactgggaacaagtcccaacaggtgcaacccctgtccagatgttgcacaatgcaggcgcgtgcccagagcccaatcccagatcggttctcgggcagaggtccgggttggggatgtatccaaaccagaaatatcctttcaggtctctctccccgagacaaaccccggcagggtctgctcctcccggagccggcttgcaggcgtgttgggggaagccagcgaggttgtttgccgggaaaggacagtttgggacccgggaggggagttccctgcgtctgggccgtggggggagctacaggccgggcgggggtgagtaaggcccagcggacgcaggaggctcagtggcggcggcggcggcggcgatggggaggagggtaattagcagggaggctctcgccacagcacgtccccacaaatgagaggccccgggccccagacaccacacaacaaagcaagaggcaattatttggctccagtgggaggggacagccctttgccggcccactgcagctgagcacccagcctccgttgaggacgcggagggtggggtgcagagacccctctcaccagccccccggcggcaagggcagggccccgagggactcccgctgggttacccttagaggaggtccctgtttgggaaggcagagccgtaggaggccccagcctgattagagccggccctcagccagcccggagcctcccacaaggcatccaggagacctcctggggaccccacagggaagcgagaatgtcctgggaccggggctggagagggcggaaggggctttttgggtcctggagaagccagtggccaacatctgaaccccccttctccagctgtggccacacaactggcaaccgggaggctctcaggcaggtggggaaaccacagaggagggagcaggagccagggagattccagagctctggcctagacctggaattcacacaattgctatgcaaaccaaatgcaaatacatcttcttttatctccccttcaaaaatcgtcaaatcaagcatatttggaagaaggccaggcctgatcagctggaggacccccagcctctgcttgcctccttctccctttccacccacccatccctacaggaaaactaagtcctacaataccttagattcacctgggacccatctgcaaaggactttcccctcttcagatgaaagagcccaaagtacagatggggaaaaagaggccttaagagattaaggtactttcccctgccctaacagcccacctggagaatgacaggcctcctggaagcttctgacaa

SEQ ID NO: 462194 - DNA, 2727 bp, Homo sapiens
tttttgttttttgttgtttaagagacaagattttactctatttcccaggctggagtgcagtggcgccatcatagcttgcagaagcctctaactcctgggctcaagcaatcctcctgactcagccttccaagtagctgggactacaggtgcgccaccacatccagctaatttttaattttttttttttgtagagatgggtgtctcgctgtgttatccaggctgatctcaaactcctggcttcaagtgatcctcccatattggcctcccaaagtgctgggattacaggtgtgagccacggcaccctgccgaatctttgagtctggacaccagtaggtggtcatggtccagttccttgcccagatgcccacagggacttccagcttccaggctgcaatcacagagaatgaagaaggaaggctgttcgagaaatatgggcagctcttacaggaaagccccccagcctctaacaggccctctctgggcatcgaaggtgccagtggtcttccaaggcccgggatgtgccctggacgtgattgctctcctgggtcttgtcttgctgctctttgcccccgccctcctcctctctacctgatggtgccaggtaaggcttcaggcatggcagaggctgaactgagagccaccctaccttgttcctgtggctccatccccctatccacacccaagagatgagatcctggggcagttggcatctgacagcctggcatcgactcatgccaacagcttggaagctgcagtaattagaaggggagagggagagagggggagagaaggagagcgaaagcaagctctagagagaaaccttctcctgcctgccgcagggcaaactacttcaaacgaattcgtttcgctcttgtgaaactgaagacaatttccttttctgtcataaaacaaattattgctcatcaggagtgctgggctagtctctttcctaagggtgtgctcttgctcttgtgcaggaggaggggaaacattaggggaggggacccagggtgcaaaagggatttccgggagccatcctgagggggagtaggaagagaagctttggatagattcatgctcctctcaggagtgaaacggcgccgtgtcccccttgtcaacctccccgactgaccagggaaagtgtccaagaaggtaccgcttggctccaaccaccaggaccgaaagagcctctgagagggtccaaccctcctccatcctcctgcctccaagccaccctggggaaggctccacctcccccctcaggcacctgttcctgctgttgaggggtgtaattagccctggcagatgaaagggcgtctttgaaagcagcaaataggtaaacaagtggttgaaaaataggaaaaggggaagaaaaaaagagaagctatcatggggtgttttctcccaggtatcagggtcgcaggtagttccaacctcaactgggaacaagtcccaacaggtgcaacccctgtccagatgttgcacaatgcaggcgcgtgcccagagcccaatcccagatcggttctcgggcagaggtccgggttggggatgtatccaaaccagaaatatcctttcaggtctctctccccgagacaaaccccggcagggtctgctcctcccggagccggcttgcaggcgtgttgggggaagccagcgaggttgtttgccgggaaaggacagtttgggacccgggaggggagttccctgcgtctgggccgtggggggagctacaggccgggcgggggtgagtaaggcccagcggacgcaggaggctcagtggcggcggcggcggcggcgatggggaggagggtaattagcagggaggctctcgccacagcacgtccccacaaatgagaggccccgggccccagacaccacacaacaaagcaagaggcaattatttggctccagtgggaggggacagccctttgccggcccactgcagctgagcacccagcctccgttgaggacgcggagggtggggtgcagagacccctctcaccagccccccggcggcaagggcagggccccgagggactcccgctgggttacccttagaggaggtccctgtttgggaaggcagagccgtaggaggccccagcctgattagagccggccctcagccagcccggagcctcccacaaggcatccaggagacctcctggggaccccacagggaagcgagaatgtcctgggaccggggctggagagggcggaaggggctttttgggtcctggagaagccagtggccaacatctgaaccccccttctccagctgtggccacacaactggcaaccgggaggctctcaggcaggtggggaaaccacagaggagggagcaggagccagggagattccagagctctggcctagacctggaattcacacaattgctatgcaaaccaaatgcaaatacatcttcttttatctccccttcaaaaatcgtcaaatcaagcatatttggaagaaggccaggcctgatcagctggaggacccccagcctctgcttgcctccttctccctttccacccacccatccctacaggaaaactaagtcctacaataccttagattcacctgggacccatctgcaaaggactttcccctcttcagatgaaagagcccaaagtacagatggggaaaaagaggccttaagagattaaggtactttcccctgccctaacagcccacctggagaatgacaggcctcctggaagcttctgacaa

SEQ ID NO: 462195 - DNA, 1443 bp, Homo sapiens
gacgtcactcatgcttctgctatttcagtcttgactgaagttctccagcagctgattgtaatgaatttgcccaatgttttgatgattggcagagacccactgtctgtgccaccgccctgagaacatcagcagcggcttccttgttccgtgggggcgctctttctgggctccagctggctgaggtgtccgcctttgcatgagccagaaggaagagcatccctggacccctgatagtcttcagtgctctggcctgtgggcactcaccgccttacatggagaccctgcagaggccacccctggtcctcctggtggcccccggcagcaagcgccctcccccacttcccgtgttagtagcagggggcctttggttctgctcccctgccagctctgccatggggccatgtgtgttccggctttatttcatggctcccccagagaagggcggggacgccagatgcagtccatgctggccacagccctgggctccagggaccgggggactctcatgatttctggtaacttcagggaagtggagcctctccaatgttacctgcatagcttgcccaccttcctgctggtgctccccctcttctcatccctgcaggtgtctccccttccactaccatctggaagcctgccctctctgccccactaccatcaggcacctcccaacaccacagagattgtccatgggcagagaacataggtctgcatctcaggtctgctgccaaacagaaacatctgtaaagatgtggatgctgatttttttttttaacagctttattgaggtatcatttgcatgctataaaacacacccattgtaagtgtataattcagtgattttttttcataaatatacaaagctgtaaaaccctaaccacaattcagtttttagaatgttaagaggaagctggttttagactgttgacaggtgaattgaatgtccctggggcccccgtggtatataatcagcccacatggatcagctggtcccagctctgaaggtggagttggagaaactggacagtgagggctgggaaagtgaaggacgggaataactctacccatcaccgagggctcagagggccccgggcctcgctgactgacatgctagacggtggcctcggcaggctgcacacagagggcaacgtgtcagggctgggggacggggagctgggtgcacggatgagtaggtttgacaggggtcccatggtgctctgagagcagaggaggctggcagcggacatccaccagcaggaagatgcagacaccagtgctaggggcagagggatgtatttatgaaatagcattttcagttttaaattgtaaaaatagatgtgtgaagctcttttcgtttctttttaaacaaagaacaaagttggtgtttttttaatttgtatggttgcccggggtggggcatgtgtgtgctttttaactaaatct

SEQ ID NO: 462196 - DNA, 1169 bp, Homo sapiens
agaaatttctggggtttggcttagcaggcccagagggccccggaagacactgagtgatttccctctgtggcgtccgtgagagtcagtgtcactgctgggccctcaccctggtataccaggcaaccaggaagaagggatgcctgctgctgtaagcctgtgccagcaacacagagacccaggccttcagcccaagcggggctctgtgcctccatcggaaacatgaaccagatttccttgtaatgggctccatatttaggcccagcagccttagatgtctggccaataggaaagctatgtccttcctgcacaatttcagccctaagaatctgtgactctccctccctggaggcctagagaacaagaggagggagggcttgaaatcaataaatggattgcacacctgcagggctctgccatttgtcatctgtgagctacgcagccattctggggcttacgctatcctgagctgcgtgtgtttccatggtctcccattatgctccactttgacccctcaaaatattgtttcaacttccaggaggctggatgatggggagagagaggcaaagagagagggagggagcaagggagttggcagaatgagagagggagcatgtccaaaaatgccggctccagccaactgtatcagatgccagctgccaataccaccctggtccctctgagtctgcctggagagtggggagccaccatgggagtccgagaccacggacaggacaacagaaactcactgctggggctcattccctttgggcagccccaggcagttacaaccaggatgactgcgacgctgtggaaggagcttgcagccagtggcccttctgcgtgggcctctgtgcggagcatgggcagaaagaaaggaaccaacgtactcagcaaacagtgctcggtgtatctgctgccaggcccagtgctgaaccctccagtcgcctcctcggtgccccctgccgacccgttgaactctccacggccttgagctgcacccacctcccttaacaggcttgcagggtcctcaccaaagcacagggctgcccctctggagggaaaaagcctcaggtggtgctgctcctgccttcctgtgaagtctttccagtctccccacaagcatgggttgagcacctactgtctcccttcacaaggctaagagctgggga

SEQ ID NO: 462197 - DNA, 2053 bp, Homo sapiens
tgccgtgcgctgagtgtccgcgtcgccctcgccgcagtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaactcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggaggccggcgcacagcctcctcctagtcaaagccaagacaaggacatgaaaaagaagaaaatgaaggaaagcgaggctgacagcgagtgcaaggggaagtctggaaaacaacgccttaccaagtggctgctgaaattagtcaggaactggctgaaagcacggtaatagccaaagtcaatggtgaactgtgggacctggaccgcccattggaaggggactcttctctagagctgcttacatttgataatgaggaagctcaagctgtgagtatttaaaaaccagacagccaaactttgggtagttatgttgtaaactacattatataagaggccacatattgaagtcacgaatgttgagttttttgggggtttctaagatttaaaatttgattattgatgtttaataaatatttgtggcatgaatgtatacaaatacatttagaatgctttggttattaaatcaatgtgtgtttgaaatgaattgttagtaggccattaaaaatgggtctactttataatttaatatgtataggagaattggaagaaattacaagactcagatatcctttaaatacttaatataattttctataaaataaataccacatttttcacatatgcatgtgatatatgatttctgatatacgttgtcgcctgaacgttgcagtcgcccttcaagctgtccattatcttcatgaaacctaagttatgattagcttaggttacaataattgcaaggcttatgctaaatttctttaaactataagaaccatattataatttctgtttaaaatatgcaaagtataaccattaaatatgtaaacagtacactattaataaaaccatatttaaaagtgattttcagaaagttcagtactgtagactgaattcacaactctccagccatagctagccatgcctcagtttttatgcactactgtctacgtgatatctgcatgtagatattgtacaagaatcttcagtacattcaccatgaaattttcgattttaaccccaaaacttatttcttcctgtttgcctaagtcagtgcattactccaccacatacccaatagctcattccagaaccttggaggttttgtgtgattcctccccgtccctcaactccatctccagtgaggggtaagcccagtagattttacttcctaaaaatatctagaatctgtccattgccactgcctgagaatccgcactcaccttgttatagaaccacccaagaaactgcctacttgctgttttgtcccctgaaattcattcccatcgagctatcaaatgatgtgtgtaaatgtaaatttaatcattttgcttaaaaccctttaatgcatcccattgcatttggagtaaaatgcaagctcctccccaaggcctgcatggtctctggcccttccttacctctctaacctttctcaagctatgctttgtcacatcccctacgtgttagtcacacaggccttcccgagtccccatgaatgcaggacactcaccatttttctatattacagagccctgttcatctccttttaaacacccttctcatcttagaattatgcacgtccaggtttgtttattgcctgtgtcttcgccaataggctgtacctgtgtgggggctgtgactatgtctgtttctttcactattgtatacccagcacagtgtttggctcaacaaatgtgt

SEQ ID NO: 462198 - DNA, 5130 bp, Homo sapiens
tgcccaaagtcaaagcagtggctacccttgagaacgtggctgacacggcaactggcatcgggagaatgtcataggccatgtgccccaggaaataagggccttggaaacaagtgatcagctgagaagggaaagggtccagcatcgcccggacttgcttgtatattctaggggattggcagccctgttcctgagagtgagctgctgatccgtctgttgtgtgcagtatctgagaccacagaagatgcaggactgaagggtggcatgttgctcctgacagcattggaagctctggagagagggcagaggctgaagtctcggaggctccccccgccccagccacaggatggcgcacaggggccatgtgcagctccgctcaaagtatctcaggttccggggcagaatcctggaaaacccaactcggagctgagtctgcaggtggctgcagggcggtgctgctgagtctgcagttaccaccacaaaaggagggcctgaaggcattgccaggagactatggaggactcacggagctctgacacccctcacctggaggaggtggcttccccccaccccccactctgcctgcaccacctttgcctggggcggccaatgcatggcagtggagtcagtaatcgcccttgctcctccccagggtcaaacccactggggtctggggattgaaattctgagaggagtgtaggaggagagtgtcttcccgaagaaaatgtaggaatgcattggcttctatcacaaaaatcctgggaatgttcctgagaagggattttggagatgctcggcctaggactggccctcgggaagatgacccgacctttgtcctgtgcagctgagtgctgaacactggtcagctctggataaagcctgatgtcaccgagctgatggcggggcgtctgcactgaacaccttccagcttggtgggggcacgggaaccagctgtcctcattaaaagtgacctggagtgagatggattcttctgcctatacctccacgtgtgggctccctgaacacccccatcgccatgggctcccaagaagtattgcttctggctgcagggctcactgcaatgctgcgacaggaggtgacaggccaaggccagcaggtgactgctctccccagaggccctgtcagctggaagcagctggtttcacataacagagaccccaggcccaggtcccctggatgcaggaggatttgcggctgcccttttggaagaggtaggctgaccatgagaactggccaaagggtctgctccttcctcctcgcggctctgggggctgcatctcggaatcctgccggccactcctccgctgcaggggtggacatgggaaccaagtggggcctttgggatgtcttcagccctcccacagccactggccagcctgcctgctgtcttcctgcccccctcgctcactcctccttctcctgggctgaaccacacccaaaagcttgatccaggactgggctaggctctgccaccacctgctctgtgacttcgggcaggccaccaattcttctgaaaaacgggagtcactgtgggcaccatcacgcccgggtacaggacgcccagtggctcagctgccccagccaggctgccctgtcctggcctcagcacacctcccacagccactgcaggcagccctggaccttctcctgctgaggccttactgccaatccctctgggagaccagacacaacaggcagcggtctgggtgactcccaggaacctgtcctccctagtggctgaggcagtaggcttggcagcagggactcagtgccctaggaggcagggctcatcccacaagttgccatggtagcccctcctcctgccccttactcatcagccaggctgtaccgacacgggctgcccaggcagggggtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggccgtgagtacccagcttggcccagagcagggacgttctctccccaggcttctccaccgggttcccgggtgggcccgtcttgggtggctggtcagggatgggaagacacagcccacgtggctggacagctgccttcacaggtggaacctgagggccggagatggaggcggtctggccctggggcacacagcacatgaggctgctgagcagagcctctgccaccgctgcctgctgggcagcatttcctgaccctggctcagcccagatgcaggggcctctcttcaggcctcacctgacaagctcttgtttcctcctgtgtgtggcgccagtttgtcaatgtctgcggagtttctgtaggagttggtttgtcttcggcatgtgacaccttgatgtctcaggtgggtggcctcctggagctgggcaggaagccaggcaagggcagagccaattccacaggtgccatggagatggcaggtgggaggggcgcagccaggtgatctgggagcaatgggccctggggtcagctgcccctgccctacctccaaggaccacaggctgtcagggaaacagaccctcccctttgaaagagtctgggccaggagaaaggggtggagatggtggagacagttctctgatctcttgcccccagaggaggtcaccaagtagagaaagacaaccggttccccagcctcaatcctaagttcggctgcctacatgcaggcatgtgtcgaaggccaaggggacacagaaggaacctccctgcttgcaggggcctgcagtccagcaggggctgcccaggtggccatggggtcacaaagcggcaaggcctcacctctccctgggggttttagcttcacggtggacctgggctttgtcctggctccacttaacctgccgctgacatgtgatgaagccccatgtgccttcgtcctccttggagctttggaagaacagtggagacagtggtaggcccaggctcaggaaggccgctgtgccattacaggctgcgggcgccaggctgtggtcaccagaggccgccgggtccgccacacaccgctggcgccgctgacagcccgctccccgcgcgggatttaggaatgtcccgggcagtggaaacggctgacgcggggcgggctgttttgcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatggaccctccccgggcctctcgtgcccaccaggtccagaccctgctcagcttacgccaggactcacacacaggtgcccacaacctgacgaccaagggtgatatttcactcacagatattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 462199 - DNA, 4057 bp, Homo sapiens
tgcccaaagtcaaagcagtggctacccttgagaacgtggctgacacggcaactggcatcgggagaatgtcataggccatgtgccccaggaaataagggccttggaaacaagtgatcagctgagaagggaaagggtccagcatcgcccggacttgcttgtatattctaggggattggcagccctgttcctgagagtgagctgctgatccgtctgttgtgtgcagtatctgagaccacagaagatgcaggactgaagggtggcatgttgctcctgacagcattggaagctctggagagagggcagaggctgaagtctcggaggctccccccgccccagccacaggatggcgcacaggggccatgtgcagctccgctcaaagtatctcaggttccggggcagaatcctggaaaacccaactcggagctgagtctgcaggtggctgcagggcggtgctgctgagtctgcagttaccaccacaaaaggagggcctgaaggcattgccaggagactatggaggactcacggagctctgacacccctcacctggaggaggtggcttccccccaccccccactctgcctgcaccacctttgcctggggcggccaatgcatggcagtggagtcagtaatcgcccttgctcctccccagggtcaaacccactggggtctggggattgaaattctgagaggagtgtaggaggagagtgtcttcccgaagaaaatgtaggaatgcattggcttctatcacaaaaatcctgggaatgttcctgagaagggattttggagatgctcggcctaggactggccctcgggaagatgacccgacctttgtcctgtgcagctgagtgctgaacactggtcagctctggataaagcctgatgtcaccgagctgatggcggggcgtctgcactgaacaccttccagcttggtgggggcacgggaaccagctgtcctcattaaaagtgacctggagtgagatggattcttctgcctatacctccacgtgtgggctccctgaacacccccatcgccatgggctcccaagaagtattgcttctggctgcagggctcactgcaatgctgcgacaggaggtgacaggccaaggccagcaggtgactgctctccccagaggccctgtcagctggaagcagctggtttcacataacagagaccccaggcccaggtcccctggatgcaggaggatttgcggctgcccttttggaagaggtaggctgaccatgagaactggccaaagggtctgctccttcctcctcgcggctctgggggctgcatctcggaatcctgccggccactcctccgctgcaggggtggacatgggaaccaagtggggcctttgggatgtcttcagccctcccacagccactggccagcctgcctgctgtcttcctgcccccctcgctcactcctccttctcctgggctgaaccacacccaaaagcttgatccaggactgggctaggctctgccaccacctgctctgtgacttcgggcaggccaccaattcttctgaaaaacgggagtcactgtgggcaccatcacgcccgggtacaggacgcccagtggctcagctgccccagccaggctgccctgtcctggcctcagcacacctcccacagccactgcaggcagccctggaccttctcctgctgaggccttactgccaatccctctgggagaccagacacaacaggcagcggtctgggtgactcccaggaacctgtcctccctagtggctgaggcagtaggcttggcagcagggactcagtgccctaggaggcagggctcatcccacaagttgccatggtagcccctcctcctgccccttactcatcagccaggctgtaccgacacgggctgcccaggcagggggtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggagcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcata

SEQ ID NO: 462200 - DNA, 1754 bp, Homo sapiens
tcccgggcttcaggtagcaccttaggcccaaatgtccaccccttgcttagagcgccctcctgagcgcaacaccccgtgccagcggctgcctgctgccgagcccgccactctgccccccacttcatggcccctgcaccgcccctctctgccactctccaccctgccctcgaggtcccggtccccctgcgtccaccagcaaccccttccagtgtgccctgctccccacgctgcagccatcgtttcgagaagcagagctcatccaatcctccacataaacctttccgtggcttcaggttcaatgacaaagtgactctccaagggcccccaaggcccatggcagaacctcctggaataagacattccctccaccctgccctttcctttctctgaccggtccagaccaggtccctcccagacgtcctctccctccctccctgaagcgccctctcacactgtaaacacatgccctgttgaaggtctatggagtaccacggttttcgcatttgtgtgcttcttgttggtgcacccgcactcggcctctgtaccccagatgtacccacactcggcctctgtaccccagatgtacccacactcggcctctgtaccctgatgtacccacacttggcctctgtaccccagatgtacccacactcggcctctgtaccccagatgtacccaccctcagcctctgtaccccagatgtacccacactcggcctctgtaccccgatgtacccacactcggcctctgtaccccgatgtacccacactcggcctccgcaccccagatgcacccacactcagcccctacaacccagatgtacccacacttagtccccccacaccccagatacacccacactcggcctctgtaccccaggtgtactcacactcggccctcataccccaggacttctgagcagagggtcctgggtggcatttcagactgaccatgtctgctgggagagctgttctttttcccacctctgtccccttctcccttccttcttccaggtcccacctcggtggcccaaaccagacatcttcgtcatcctggcctcctccatccgtgcccgtgtttaccggggcaccaagccctgctggttctgcctctgacctcctgtcccaacttttcaccctctgccttccttaagggctttgtcacctcgcactcaggctgccaaactggttccctgcctctgtcatctctctgtccccgtctaatcatttgcctctcctatcactggttacctctgtaatgcaggtttaatcatgcctctccctgcctaaaaccttcccctggctcctattctggaagagtgtcgtagggcagcatgtaaaacgccacgcatgccccgcccagcctgccttttaatcttcatctctggccacactcttctagcactgcctgtctgcccagctcccgcccatgcccccccgccccgcgcagccttctgtcctgtaaccaccttccccacaatatgccatcattccccctgttaatggctctgcccttgcccactgtcctatcctggaatgactttccctcatccttctttcttctaatgacctcctattcatccctcaaaacccagtgcaaaggatcccatgatctcctgccttcaggcaaaatgactcaccttcctcctcaggccaccccagctcccactattggcgatcccatcatcctttgctaacacaccacctcctggatcacctgggctcctctggactggagatctcctctcaaacacc

SEQ ID NO: 462201 - DNA, 428 bp, Homo sapiens
tcccgggcttcaggtagcaccttaggcccaaatgtccaccccttgcttagagcgccctcctgagcgcaacaccccgtgccagcggctgcctgctgccgagcccgccactctgccccccacttcatggcccctgcaccgcccctctctgccactctccaccctgccctcgaggtcccggtccccctgcgtccaccagcaaccccttccagtgtgccctgctccccacgctgcacctggccaacatggtgaaaccccgtctctactaaaaatacaaaaattagccgggcgtgtggcaggcacctttaatctcagctacttgggaggccgaggcaggagaatcacttgaactctggaggcagaggttgcagtgagccgagtttgtatcactgcactccagcctgggcaacagagcaagacaccgtctcaaa

SEQ ID NO: 462202 - DNA, 1249 bp, Homo sapiens
ttaccagaaagagctacacaatggtgaatccttcctctatcactttgagatgtatatttcctatacatcaggagtgtctttctcaagaacgacaagagactgtgtcaccagagctgcgggtctccacatggcactgcagcagttccagcagctctatctgtgggcattggcctggggtcacgaaccatcaggttctggccaatgttgggtttcaccatgtcaagctagtactgagctgtaagacaaagtcctgcatttacttctctctccctccctgccagtggatagagtcactctgcactgtgctgcccaggactgggggagaaaaggtaggagcagtctcttggttgccaaggctgatgctcatctgggtcacatccaaatcccatgctgccaggaccaacacagccctgggtgctcttgtggcccaggctgacatggcctgtctgccagtggggttcactcgtggcctaaggccactgtggaaggctagcagtggtgtgagctggaacacaagaccatggtttggggctgaaggtttctgccttgcactgggtcttccatgggaaacttgtgaatgacgtcatgagacatgtgaatgatgacatgtgaatgagacatgtgaatgatgcctacctaacgtagaagggactctcatgtcagagacagcaataatcaaccacagtggggaaaaaaaaggttaatttgaatttaattacatcaataatactttctcaatcatgaatactgtgattacaaaaataagtgaacattgaatataattatgcctctccatcaatgtcgtccctctttttaaacatacaatttaattatctaattgagtttgaattatttgttataataaacacactgattcagagtaatttacggaagtgctagcaccttagttctttctaaagtgacacttctaatttttatttaatcttcattttgatgtttcaaaaatcattacacatatgggatttctatccagtattgattttctaatgttgagtaaggtgtgagctcctggtaaaagctttgccacattctttacatttgaagaatttctctccagtatggactctctgatgttgagtaaggtgtgagccccagataaaagctttgccacattcttcacatttgaaagacttctctccagtatggattctttgatgtcgagtaaggtgtgagcccctgttaaaggctttgccacattctttacatttgaagtgtttctctccagtat

SEQ ID NO: 462203 - DNA, 1017 bp, Homo sapiens
  misc_feature (4)..(5): n is a, c, g, or t
  misc_feature (9)..(10): n is a, c, g, or t
  misc_feature (12)..(14): n is a, c, g, or t
gganngttnntnnncagatgctggaggagcatgacagaggagaggtggagaaatgaagattcagggaagtctggggcacagcacccccttggcctgagcaaggggagcctacagccattccagctcttcagacacccctttgccatcctctctggagctccaactttggagcatgaaacgataggagctgctgaggtgcagcctggagaccccttgggtgccttggcatctgtccgcttcctcagccgctgggtgctcagccccctgctagccccaggcctttcagagctgatggccttgttccgcttgttctccagacacggtttaggtaatgcacattcttgtgaccctgccacagatgggttttttgccaataacaggaacatgcagaggctgctcagagcagttttggttggtagtgaagttggaggatgtggagcaccgtgacaaccagcagccagtgtctgacctatttagtatccaagtaccacacttatttcactcagctgaagtttttcaaggtttatttatgttgtagcatgtatcagaattttattcctttttatggttgaatcatatcccattgtatgtacatgctgcattttgtgtgtccactcatctgttggtggatagattgtttccatctttggctattgtgaataattctgctatgaacaccaatgtacaagtatctgtttgagtccctattttcaattcttttgagtatacacttaggagtggaattgctgaatcatatggtaactttatgtttatgttctgagaagccacagactgttttccatagcgtctgcaccatttcacattcccaccatcaatgcacaagtattccgatacttctacatcctcactcacacttgttatttttcttaaaaaaaaaaataacagacaacctattggatgtgaaatgatatctcattgtggttttgatagacttgtaggcagaaatcatactgaggagcaccaccaatacaagagtacaccaatacaggagcacca

SEQ ID NO: 462204 - DNA, 1597 bp, Homo sapiens
agccgtggcttatactttgtcgaataccatgaatctgctggcacatttaggctttcttgttcctgagcccctgaccttctacctgctggggatcactcctcagcccctgaccttctacctgctggggatcactcctcagcccctgaccttctacctgctggggatcactccaccacccctgaccttctacctgctggagatcactcctccacccctgaccttctacctgctggggatcactcctcaacccctgaccttctacctgctggggatcactcctccacccctgaccttctacctgctggggatcactcctccgcccctgaccttctacctgctggggatcactcctcagcccctgaccttctacctgctggggatcagtcctcagcccctgaccttctacctgctggggatcactcctcagcccctgaccttctacctgctggggatcactcctccgcccctgaccttctacctgctggggatcactcctcagcctctgaccttctacctgctggggatcactcctcagcccctgaccttctacctgctggggatcactcctcagcccctgaccttctacctgctggggatcactccaccacccctgaccttctacctgctggggatcactccaccacccctgaccttctacctgctggggatcactcctcagcccctgaccttctacctgctggggatcactcctccacccctgaccttctacctgctggggatcactcctcagcccctgaccttctacctgctggggatcactcctccacccctgaccttctacctgctggggatcactcctcagcccctgaccttctacctgctggggatcactcctcagcccctgaccttctacctgctggggatcactcctcagcctctgaccttctacctgctggggatcactcctcagcccctgaccttctacctgctggggatcactcctcagcccctgaccttctacctgctggggatcactccaccacccctgaccttctacctgctggggatcactccaccacccctgaccttctacctactggggatcactcctcagaccctggtacctgctgctctgctctctgtctccatgggtctgtctgctctggaaatgtcatggcaatggaatcacacaggcatgcaggttgccttctgcacctgccttcttccactgagcaaaaggtttcaaaggtgcctcgatgccatcatagacgtggctccttcctgccatttgtgactgtatgatgctccatgtgtgcgaacagactacattttatttcttgtttgatagctgatagacatttggactgcctccacttcccggctctaacactgctgtgaacattaacatacgggtctttgttctcatgtctctcgggcggggcatatggtaattccatgttcaattttttcaggaacgcttagactgttctctagagtggctgcaccctgttccaatcccacccacagtgcatgcaggttccagttcctctgcaacctctttcatgtccaggcctttcatcccgccagtttggtttcattgtactgacaagctcagctggcatcagggaccatgaag

SEQ ID NO: 462205 - DNA, 656 bp, Homo sapiens
ctgggacaagcagtctttggaggatggaactggggttgggaataccttcagggcttggaaccacagtacttctccaccaccaaatatgcagccttcacagtcccaactacctccttacatgctggtgcaaatcgggcgttccactcaggtctgagggtgccaccagccacctgcacacctgcgcatgctcagtggagctcagtggagctcaccggagcagtcgtgtctgccagacaaaagctatggctcttgggaagagagggaagatagcgacacagatccagttactagcaggaagcccagtttgttctcccgattcagtcccaagcatcccaaaggacttcaacttctggggagcaaagggcctccttcacctggttagaaaacctcgagggaagaagaacagcggcattgatgaagaatctggcatccagtgactgtcattctttcctctggttctgacattctccagatgtccatgagcaggagacgaggacagcagcaaactccagcttaacataagatggagaggctgttgggatttctgagggaccagagatcttttggctgcaactcagaggagggtttgggaactggaagtcagaaatcaggagttcgagaccagcctggtgaagccccatctttaccaaaaaaaa

SEQ ID NO: 462206 - DNA, 5791 bp, Homo sapiens
ttttttatttttattttttatttttatttttttggaggcagccttattctgtgtgtgccaccgcgcccggcctgtttttttctttttttaaaattattattattattattattattattattattattattattattatttttatcaataggtttttggggaacaggaggatctagtattggtttacctcacagcgaacgaaaactcagctcactgactatttaatttgtagactatactaatcactgctgatttgtttctatctcatcacagctcccatttactgaatagctacactgggctaggcactgaactaggtgctgtcacatgcattgtcccttatgatctcacagatactttgcagaagagggagtggcgcgtcccactttatattatatagagatgagagaggggaatctctgagggatgtagtaacttgccaaggctacacagctggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactttgattgaggttctgtgtactaagatacccgtacctcactcagagcctgacagttcgtgggaactgcgggccgaggacgccaacagcattgcagaagtgcctcttgccacataagcgaagaccttttcttcagatgcactttgcttgtgtgttttcccaacaagggaaaaggagttttttggttttttgccgggggcggggaggtgcggtgggggagggggattgggtcagaaaggcacgtgactcctccgcgctttgtttcgtaaagcctgagactccccgagtcttccgacttctccctgacatggccctcgtttgggcttcgtcccccgcagaggaagcggaagtgcaggtttcccctctccttgttcttggatggcagctgtggttccgggattactcttgggatgctgacgctggccatgtgcgtaggcttcgtcctcagtggctcccaccctagcgcctcagcccaggacctggtggcctgtggcttcctcggcagtgggaggctctgctgctcccccggagaccgcagtctttcaccctcactctctactgctgcaccaggagctgcttttcaaattctggttttcccagtgggtgagatggccccttgaactatgtattccatgtcaagatggtggttatcttacttgttaactcattttgggcatttaggttgtacacctttgtaattaaatatagagacaacgatcacttagaccagtttgcgtagtgaatatgattcagcaaagtgaagacctggtggcttttctttctctgcagtgtaaagaccctggtagctgaagcagcagctccctgtgctcttaacgcagccctcccaggaaagccgggccaggttcccaggcctgcttcccatctgcaaacatgtcacggtggcgccatccaccctgtgcccatcgtgggccttaacgcagtggtttctgttgagtgtgatggcatggccgcgtgctgccacctgggaaccacagcagccttcaggtgcatctctcctggctgtgcctttcacatccctgagcactgctcctaggagtattcgtgtcctctctacctgtggaatacgggcctttgttcctaaaggtgaactgatctaaggtagccatgacagccatccttgtggacagtttccgctttggaggccaaattgggtcatgtggagagattagtgatgaacgctccatgtgcaacttttgcacctacatagttgtaaacgttcagtttcaaatgcttctgaggcattgagtatgcagtttcaaaattcaggacttagtatttggcctaaatagagagtggccgatcccaagtaagtagcatttatggtgacatttctggcgaccttgcagttctgaaggtgttgccctggacagggaagccgtgggggtgtgtgcccgagtaaccaacgtgaccgactggggactctctgatttctcccccttctttaaaattctcagtcgcagtggctgggatgaaagagggattgcaggggtacactgacaggtgacttaggagtcatttgctgataggaaccaggggtgggagaggcaagaggaggaggttatgtttcctttgaaaacaactccgaagtgtgctgtctagtatggaggcctgtgtgtgtctttctccccccacctccagttttaaacactatgatattgtcagttttggatttgaggcttgataacaatctttttcttccagtttttgccaaggagtgtactgtccttaatgtctgtctggtaccttgtctggggccccttcgttgtgtctacgtgccctccccaaggcccctcttgctgggttcagggcccagtggagagcactgtgccagcctggggaggggctgcctttgactgcatgtcctgacccctggctcagcccaggctggcccaggccctgcagggcgacaccactctgtgtccactctgcccctctgactgctgcccctttctttgacagccggcagagcacttctgcaggcaggaggacaggatgcaaggtgttctccaagaccagaactaaaagtgcccaacagcttgagaagagggcactggagagaggggcagggaagcgcccttctcctcggctgtgcttctgagtaatggctcccgcagacctggggagggcctggggaggggtggccgcggtggttcctgatatcaggtgtgtaaggtgcaatgcgtgctgctaaccctaggagaaatttggggaaaatatttgtagttttctcgccaaactttgagcttcctcattgaaatttttcagtctttcagcctaaacgttattatgagcaagaatatcttttctaacctaatctgtggaataaaacacagcatttggcaagaagaggctgttaaatactcagtcagcatcactgttccagcgtgtaccaaaccacagagatgaaaggctcagacgaaagtcaggtgcacgctgcgtggctggagaatcccgctcccacccggcaagggggcgagctggtccctgggcggtgtcagacaccttctgaaggtgccaggccagggccaggggagcttcaactcgccctccttgggttggcctttttcaccagaattcaagaagccagatttgtgctgtgactgcgatggggcaggcttctaaacactactggtggccctggagcctttctctgaggcttttttcttattcagaaggagaattaaaaattcccccagcggcctggagaagggaacctttggaaaagcttgccttcttttaaaagcaaatgcatgtgcaggagtagacactttacaaataaccagtagccttggggtcgaaatttgcttaaatcatggtaaaggatctcatttctcttttgtgctgattgaaccttctagcagtttggaagtgttttcctgtgaacccttagctggggactgagggtaaatgccttaaaaatggaggcatggaaaatcagaaaggagctatcacaatcattcttttctcaaaggcgttcaggaattctgaggaagaaatgcagtgacaggatgggattttaggggcaaggacaccgtccgggcggggcccagggctctccactggctgacttcacccccagggcccagctggcacgtggccaggcagccatttctccccagttcctccacttcctggggttcattttaaataataaattgtaaagtatgaaatgagtgctgaagttgcctgcatac

SEQ ID NO: 462207 - DNA, 972 bp, Homo sapiens
gtctaattttccgctgcgcttcttgttccttcgatgtctactgcagtgggggtctcagtgggaatggactaaggatgcaggaaaagtatgggggtctgagtacaggcagatttcatagaatgattccagcatgcattaagcacattgtttatccaaggtgctgtgctcagagttgtggcgatccagagagaccaggtcgcttccaccttcaaggagtctgcaagttcatgtgcacagccctgtgggagaaggcgatttcaggaagcctagcccaacccctctctcaaacgcctccaaggcactgccacggatgggttccccacccccagacgccatggtgttgggcagatctgcttcttttgctaagatcaagggcaaatgggccactgcttactaagagagcctacaaacgcaaggcagctcccgtcccaggtctgctgcgcttcaagacagcaccaacagcagctgagaccaagaacctactacccagagggcatacttttcactcagacattagaaagcgcattgtagtggcctgatttgtggagtgagaactattatgagaagaaatggaagcccttgaaaggccaaatggaagctcttgacattttcctatccccaatactagcctccaagaaaaattagaagcaatgccacatttctggaggaattttagagattagcattaccattcaagatatgagagatgaagagataaggtctaactgttacctgggctgaacccttggacttctaggctcaagtgattctctcactttccaagtagctgggactacaggcacatgccaccggatatggagctttactggggcagatcaacacggcctcaggcaatccatcagtagagtgagaccaaagaagtttacctttacttagcatatctatatagcaaacctgcacatgtatccctgaacccagaataaaaattaaaaaataaaataaaataaatgt

SEQ ID NO: 462208 - DNA, 3289 bp, Homo sapiens
caacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataatccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaatagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagtctttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacagtgagtattaattgagagttaaaactgtgccatatcagtttttggaaaagtatggttattttagaataatacaacctaccttaatcccgatcaattatccaataagagctttgagacttcttattatccttacatgctctttctgactggctatctgagatgcacacaaacacacaccttttttaagttgaattgttctctgagaattgcttttttgtgctaaatttaaatcatactgttacttggttttctagaatgcccttgatctttgagtttcttccattttctggattgtgcgcatgtgcacacacacacaggtagacacacgtacgttccttggaaagactatagatgatccatataatgcatcatgttttctaaaggagaagtttgcaaaaagaccc

SEQ ID NO: 462209 - DNA, 680 bp, Homo sapiens
ttctatgactgaattctggaactgaagatcatcagatgttggaactaaatgcagattattttattcgttattaatccttcataaagacttttatttatgtattgtcctattctttttttattaattaccctacaatagggaccagcaaactttttctgtaaagggccaaatagtaaatatttaaggctttgcagaccatacactctctataggagttactgaactctgctgttgtagttcttcagacggtatgtgtatgaattagcctggttgcgttccagtgaaactttatgacacaggctggatttggcccatgggtctcaacctttgttaatctttgcgttagaacattatgtataatttatattgaaaataaatccatccttgatagttttgcccataattgtctgtactaagcattagaatggcagattgtttagagccctggttagattcatgttctgtcctttgaatctgcattagtcctgtgctgttagtacttaaaatcagagagtaatgcagtccagtatatgaccataagttggtggtggtgtagggggatggtttagtggaattacaattttctcctttgactttaggcatccctcaaaactaaacctatccacacaatcataaggaaacgagcccctccctgcaacaatgacttctgtcgactgggt

SEQ ID NO: 462210 - DNA, 408 bp, Homo sapiens
cctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggtaagattgtaattttcaggattctttaaggctaattagtcatacttgaattgtatactggcttgtaagtaactcgatttacaatctagttttgtgatatctatttgtgagggtgtatggggggtggagttgggagggaagtgtctccaaaatgtttggtttagttaataggaataacttaagatacttcatttgaatagacttaaaaaagtatgtcttgcttag

SEQ ID NO: 462211 - DNA, 11677 bp, Homo sapiens
caacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataatccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaatagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagtctttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaagctgatggctgggggctccaccttcgcttgtactgccacctcaacatcagtggtgactccccggaaaaccactaaagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggttaatggtaagagttacccgcaggctaagttgctattgggacagatgggggcattgcatccagccaataggctagctgcttatatcacaggcaggttgcgaccctcagtcctggacctctcaaccctcagtactgtcatctccaaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattgtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacacagtcttttagtggtaaaggacagtaggtgttcttaagggaag

SEQ ID NO: 462212 - DNA, 2430 bp, Homo sapiens
ggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtcatcatggaaacctcttgggaatagagtataggcttcccagtgatgttagtcttatccatcctcctctatacatgtgagatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtcaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttataaaaattaaataaataaataaaaagacaac

SEQ ID NO: 462213 - DNA, 2401 bp, Homo sapiens
ggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtttctggaagcctggaagttatgaagtccatgttcaaggtgctgacagatctggtgcctggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtcaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttataaaaattaaataaataaataaaaagacaac

SEQ ID NO: 462214 - DNA, 2342 bp, Homo sapiens
ggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgggagacaggaattgcagggagaatcatgcatcaatgcctggaaaggtgattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtcaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttataaaaattaaataaataaataaaaagacaac

SEQ ID NO: 462215 - DNA, 543 bp, Homo sapiens
aaaaaccaggctcaccactcactcacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggctgacagtgtggcagcttgaagccgccaaaccaaagacgtcaggtcactctggtaggaacaatgtctagagataaggcgtggccagctcaggcctggtcctccacagagttgagaggctaaataaagcctccaaacatctggttccaggccaagcaaagacacaatctctccagtagcactggcctccaagacaacaagcagggctggctctctggctgcgactcaaggctatagggcatgcagccagagagtctccgtcgaactggtacgagctcgatac

SEQ ID NO: 462216 - DNA, 3215 bp, Homo sapiens
aaaaaccaggctcaccactcactcacccattcccaccgggagccaggcactgggaatacgaaggtgaaggagaggtgcccacgtgcctagaatgctccggagcgagttctctaaagagttccaggtcccacagcctctgccacgctgcctacctgtctccagcaccgggaagctgcctgtcctcacttcctcccagccagaacttgtgaaatgcagtcctggtgggttcgtttatcctcagcatcctgcacaatctgctaggctgacagtgtggcagcttgaagccgccaaaccaaagacgtcaggtcactctggtaggaacaatgtctagagataaggcgtggccagctcaggcctggtcctccacagagttgagaggctaaataaagcctccaaacatctggttccaggccaagcaaagacacaatctctccagtagcactggcctccaagacaacaagcagggctggctctctggctgcgactcaaggctatagggcatgcagcgagggtctgaggcttcacagacggtagaagtcagttcacgggccacagctggctgccaggactgacccagtgcttttccttcaaggaagctcagtgacctctggctcttgccctttgcaaacaccctcttgcctcagctcggagacaccaagtccctgtctcctggctgggaagagggtggcccctctcttgcggttgccgtggaaacgggggattcctgcccacccgctccagggaggcggcgaggctcgggctgacaggcgcgccaggtgactcctggcacagccgccggagccctgagctgggctggcctggagggggcggccaccactgccccgaggacaccggtcggggaggcaggcccgcccctctcccccgggaacagctgccggggccgggaccctccgccgagggcttccacccggccgcgcgctctgcgcccgcatcagccatttctcccgcgcaccttcggcagcgccggcccggccccccccagcgcccagggcgtgtcacgctcccaccttcacagccaccaggaagggggaccctgagccggggctggtcggggttcccagctcgcactcctccaggagaaacacatcttcgtcctccagaaccttgtccagcaagcctatcgcctcctcttcctcctccatggcagccggagcccgcggagggcagacaggaagcggggtccacgcagcggcggcgggaggagggaggagggaggaggcgggcgggagggggggcaggtctacacccgcgcgcccggcctggggctcccgacccgggactgcatcccggacctagtccagcccgctccgccgccgccgccgccgcctcgcgcgtcctcgcccggcgaaagggggagcaaggcccgggcagcccctgacgccgtgcccggcccgtggcggaggcgaacccgccgcacagcagcccagcgccctcctccgtgtcccgcccggccccgcagggcccgcccttcccgggctccggggctcgggctcgcgctcgctccgaacacacaggaaacgcgcgtcgcgaggtggagccgcccgtcctctggggttgcggggccgcggctggcggaggcttctgcggcggaggaggagcgaggaggccgcggccgggccggggtggggtggagcggggaggccgcttcccagacgcatcttcattccccgcgcgcggccgagccaggagcccggcgagcaggggcgacccccagagccaccccggagtccccatgcgccggagcccccttccggaggggaggccccggcccgcccagaagccacagccgcgtcccgccgccgctggaggagtcaggctttgcaacagacaggcctgacctgcccccaggcaggagcgcggcgccaccactgtcctgcacaggagcggtgggcgtcccactcacagggaccaggatccccctcctccaagcagcccccctcctccgagcagtccccccactcacggacgctactgacaccagcacccccacctcctctgagcagcccccccactcacagaccagcccccctactcacaggcgctgcagagaccaggacccccacctcctctgagcagcctcccacctactcacaggcactgctgagaccagcacccccacctcctccaagcagcccccccagccaccccaccgcagggagccatcctgcaaggggagtgcacacagaacccaggacaggcaccatctccggccctgcccactcccagccagcttcccctggcttctccaatggttgcagaacccccaactgtgcagggagtgaggccacattctggtccccctggccctagttcccagatgcacatacacctccttccatgggaggaggagtccagaggaggccctgggaaaagctcttttacaacccaacgatggagcaaaggttgcaaacggcacccatgagggtgcggccacaattcctcatttggtgcgggcgggtgaggctgtggcgagggcttgggaacgaccaggcctggcattccccagggcacaagtatgccagctcagggcctggtgacacgaagaagggcctaaaaccccacaggcccctgctgtgttccttcctccactcaagaggacatgaggtgcccttggaagtctgccaggatatcctcgtccccgttccccacacctctacacggcatgagaagcagcccttctcccttccaggccagtggtggcccgctgccagctgcagccctggtgtcttgctgggctctaggtctagcacctgccccggccactgggtctcctcacttggaagcccagccacggcccttccactccacacatctggaccaaaggacccttcctccttctgaaacagcttccccttccgggtttccacttctgttagtgcggccgccatcttacgagtcttccttccctcaacccccacatcccttttaccaagtccttcgggagcctcccgtgactccccgttggctgcgtcagatgtgcccgctggtgccctcagagcccactctacgttcccaatcgtggcacttctattttaacttctttattttcctgttacatcactaacaattctaactctgtagacacacataataaagaaagagaaagtctcctctggttccctctgacagagggagcctctaagagttagttatacatttttccttatttgtgtccacgaataaactatacatat

SEQ ID NO: 462217 - DNA, 2048 bp, Homo sapiens
aggactggttaggaggggcacaggaatgaagcaccccgacagtcaccccgccctctggtgtcctcccaccccgagcccgatcttcccccttcacgcctgccccgggccaatagcctcctaactgcgtcctctctgattgcgtgtgtcgtgctcattacgccctatccgtcgtttcttcgctccacaaacgtttactgagcgccttcaacttgccaggcactaattagactagcgcagagaaacggggataagtactgatgagggtcccagccctcagcgatcggatttcagagggggagataaaggactgcccagaagggtggtgagtggagtagttgatataaacaacgaggtgcgatgaaatacacaggagggctgctaatcacatatggggtgggtgccgagggcccttaattaagggaggcttcctggacgggtgacacccaagcggagtcctgacgacccgcgtcagaagtagtcaggcgaggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacaggtctcttccacagacctatcttgttttcaccccctgtctcttttggttcagtcttttcgctcatacaaacaaggaagtcgcccctagcccagccgcggctccttagctggaggcgggcccgggggtggagtcaaccgcggtggccacgcctcctgggaaagggcagggcatgcaaattcgaaatgaaagcccggaaaccccggaactagaactggtatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatatcagtgcttgagatattttgcagaccctgcacttgatggatcagctggcaccacccagactgattaactggctcatgtgatcttgtggtccccacccaggaacttaatcagcacaaggagacagcttcaactccctatgatttcatccctgaccaatcagcactcctgggctcactggcttccccctacccaccaagttgtccttaaaaagtctgctccccaaatgctcgggtagactgatttgggtaataataaaactccggtctcccacacagccagc

SEQ ID NO: 462218 - DNA, 1740 bp, Homo sapiens
aggactggttaggaggggcacaggaatgaagcaccccgacagtcaccccgccctctggtgtcctcccaccccgagcccgatcttcccccttcacgcctgccccgggccaatagcctcctaactgcgtcctctctgattgcgtgtgtcgtgctcattacgccctatccgtcgtttcttcgctccacaaacgtttactgagcgccttcaacttgccaggcactaattagactagcgcagagaaacggggataagtactgatgagggtcccagccctcagcgatcggatttcagagggggagataaaggactgcccagaagggtggtgagtggagtagttgatataaacaacgaggtgcgatgaaatacacaggagggctgctaatcacatatggggtgggtgccgagggcccttaattaagggaggcttcctggacgggtgacacccaagcggagtcctgacgacccgcgtcagaagtagtcaggcgaggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacaggtctcttccacagacctatcttgttttcaccccctgtctcttttggttcagtcttttcgctcatacaaacaaggaagtcgcccctagcccagccgcggctccttagctggaggcgggcccgggggtggagtcaaccgcggtggccacgcctcctgggaaagggcagggcatgcaaattcgaaatgaaagcccggaaaccccggaactagaactggtatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggtcctccatgataagttgctcccgatccagaagtattgccccagctgcaaagagccctgattctcaaatgtggtcgtgatcatggttactgattggtccataacaagaaagttaaa

SEQ ID NO: 462219 - DNA, 1832 bp, Homo sapiens
aggactggttaggaggggcacaggaatgaagcaccccgacagtcaccccgccctctggtgtcctcccaccccgagcccgatcttcccccttcacgcctgccccgggccaatagcctcctaactgcgtcctctctgattgcgtgtgtcgtgctcattacgccctatccgtcgtttcttcgctccacaaacgtttactgagcgccttcaacttgccaggcactaattagactagcgcagagaaacggggataagtactgatgagggtcccagccctcagcgatcggatttcagagggggagataaaggactgcccagaagggtggtgagtggagtagttgatataaacaacgaggtgcgatgaaatacacaggagggctgctaatcacatatggggtgggtgccgagggcccttaattaagggaggcttcctggacgggtgacacccaagcggagtcctgacgacccgcgtcagaagtagtcaggcgaggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacagatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatatcagtgcttgagatattttgcagaccctgcacttgatggatcagctggcaccacccagactgattaactggctcatgtgatcttgtggtccccacccaggaacttaatcagcacaaggagacagcttcaactccctatgatttcatccctgaccaatcagcactcctgggctcactggcttccccctacccaccaagttgtccttaaaaagtctgctccccaaatgctcgggtagactgatttgggtaataataaaactccggtctcccacacagccagc

SEQ ID NO: 462220 - DNA, 2979 bp, Homo sapiens
aggactggttaggaggggcacaggaatgaagcaccccgacagtcaccccgccctctggtgtcctcccaccccgagcccgatcttcccccttcacgcctgccccgggccaatagcctcctaactgcgtcctctctgattgcgtgtgtcgtgctcattacgccctatccgtcgtttcttcgctccacaaacgtttactgagcgccttcaacttgccaggcactaattagactagcgcagagaaacggggataagtactgatgagggtcccagccctcagcgatcggatttcagagggggagataaaggactgcccagaagggtggtgagtggagtagttgatataaacaacgaggtgcgatgaaatacacaggagggctgctaatcacatatggggtgggtgccgagggcccttaattaagggaggcttcctggacgggtgacacccaagcggagtcctgacgacccgcgtcagaagtagtcaggcgaggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacaggtctcttccacagacctatcttgttttcaccccctgtctcttttggttcagtcttttcgctcatacaaacaaggaagtcgcccctagcccagccgcggctccttagctggaggcgggcccgggggtggagtcaaccgcggtggccacgcctcctgggaaagggcagggcatgcaaattcgaaatgaaagcccggaaaccccggaactagaactggtatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatgtaaggaagagcctgtcagagcgaggctggggtgctgcgtgttggggaggtggaggtgtggcttcccgggagaagctccacccgctggctgagtctggcacataaaccagtctgtgaggggatggatgtgggtgtaatgggggcaattacagtaggaaggagcccacgtggagcctgcattctctgggacagggcattactgcattctctgggacaggctaaggcccagatcctaccttcccaggtggctggatgggtcatagatgtatgaaccggtcccctcattttctgattgccctgtgcttaacgtttctgtacctttactgaggctctttcctccaactccagtgcccagaccccccttctcctgaacatgaatgcctgtccatggaaattcgaccctcgcgctctctttcctgggagtgtgctatggtctcctcgccggtcttccggtttctcggctctggccccctgtggcttgtctgagctctcgcgttcacagggaagtagtggtcgcgctcactgggctaccgccctccctctgcgcgccccctccgggggcagggagcccacgaggcccagcccgatcctaccccctcctgggtcacctcctggacccccgctcctcccgcccagccccccgccccgtgccgccccagccactcggtcctccgggcccaccccagggcgtcggaactggtggttccctcggcggttccaggcccctctcctccttcccgggcagaagcagcttcgcagcgccactcactgagcggagattaccagggcccgtttcccaaggctccgcccagccctcgaacctgtgggagcgagcgctccctcgcctcaacgaaaactcgccggtcgagacggttgagaaatggctagagggacggagacctaagtgcctgtttctgtgtgatccaatgtagcatgtttttttcagttgaataactgattttttttggtctgaggacgatatatttaagtggggttttggaatagaaagatgaaataggagctggttttttccactctgcgcatcgacttggtattgccgtgtttccaaagagggtcaaaacacgttttacaaagaacagatttacttacattcgcgttggtttcattatgtggtgttgtgtatgtgtgtgtgtgtttttgtgttgtataaggaaagtattggtgggtggtattacttctttgcttctaacc

SEQ ID NO: 462221 - DNA, 1954 bp, Homo sapiens
aggactggttaggaggggcacaggaatgaagcaccccgacagtcaccccgccctctggtgtcctcccaccccgagcccgatcttcccccttcacgcctgccccgggccaatagcctcctaactgcgtcctctctgattgcgtgtgtcgtgctcattacgccctatccgtcgtttcttcgctccacaaacgtttactgagcgccttcaacttgccaggcactaattagactagcgcagagaaacggggataagtactgatgagggtcccagccctcagcgatcggatttcagagggggagataaaggactgcccagaagggtggtgagtggagtagttgatataaacaacgaggtgcgatgaaatacacaggagggctgctaatcacatatggggtgggtgccgagggcccttaattaagggaggcttcctggacgggtgacacccaagcggagtcctgacgacccgcgtcagaagtagtcaggcgaggaggagggtaaaggaatccacgtcccaagcagagaagcagctttccctacacagcacaggacacggtccgcgcacagaagccgcaggagacgcaggcacaggggctggggagaatccttgctgggccctcgccgtccatgcgccgcctccctctgcccggtgtctggtgtcagcctcctgcctggcagaggaactccagcccctgctccccgaagctcctccaggccttctgcttccctgactcggaatgggcccgctgtccagtgggtacaaggctggtctccccgcccactggtgacgacgtaaagatccagctcagcctggtttcccctggtgatgatatcttgcgactcgtctttctccaggaaaacagggaccgctctccgcctacagatggagtctcactctgtcgcccaggctggagtgtagtagcgcaatcttggctcactgcaacctcggactcccaggttcaagagattctcctgcatcagcctcccaagtagctgggactacagatctcttcaactacctgtgaaaactgatgtgatgaaaaggggaatttgaaggagccattccagaagacagggcgaaaactgaagtgcaatcagggccaagaaaaacagaaatagcaggacctggagttgcataggttgaatagttgaataggctgctctcctcagctggcaggaaacctggcagcctcctggtgcccaaggactgaaaaccttagaagcacctggagttggcagccttggcatggtcaggttggcacctctggaggtgcccaggcttccctggcagcattgtgagcagtggatggtgttgaagggcagccagaggaggaatggaacacatgctccttgctaaccacacggacaaggccacgttcacaggtacacaaaggcaacgcagttgctcaggtgcttcggtatcacagccaagaccccttcgggggaagctagtcggatactgggacccacattccagactactgagccgcggtcgcgccctcggctccgtttctgctccctccaccccacgaggacgggggtggaaggccaccttcgatgggtgcatcctccacgatgacctgctaacaaaggtgcatggatttcagagtctgattggcctacaacagcatttggcttgtggagacagtggttccctgatgaaaaactgccatgatatcagtgcttgagatattttgcagaccctgcacttgatggatcagctggcaccacccagactgattaactggctcatgtgatcttgtggtccccacccaggaacttaatcagcacaaggagacagcttcaactccctatgatttcatccctgaccaatcagcactcctgggctcactggcttccccctacccaccaagttgtccttaaaaagtctgctccccaaatgctcgggtagactgatttgggtaataataaaactccggtctcccacacagccagc

SEQ ID NO: 462222 - DNA, 885 bp, Homo sapiens
aggaagcggatctcgcaagctccgagcgtcagctgccggttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccga

SEQ ID NO: 462223 - DNA, 4435 bp, Homo sapiens
gcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcttgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagactctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggctcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgattttttttttaagcaagatttgttttactataaataagtggattatttcaatgcaggcaaaattgtgaagttctgttgggaaagatagcatgcttttcgtgtgcaagtacctgtcagtaataagccttttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaaaaggtaatgtttgtataatgtggttgcaaactcttaatttatactattgcacttttagtattttgtattagggaggtttgtctataatttgaaaatttaaaaaaatgtaaagtattttataaatagtacttcagtttaaggaaaatgggaaaactgttacagttccttgttttgtcttatggtcaaacaatattagaaatctctgccacttgaaaagccaccaagacttgtcagcttttcagtaaagtagggcctgccgtttcttaaattaaaatgatttatttaacttttccacaaagcccactttaaaactgtgaccgccccctaacgaaaccttggtgaattcatcctaggactatgacgtcagtacaagccaggaaggaactaggataaccttctgcaggtctgattttcatgtaagc

SEQ ID NO: 462224 - DNA, 502 bp, Homo sapiens
tgctggcaggtggccctgggatgttctagaattaatgtttctttgtttgagagaaagcaagaggagaggggcacagtcagagagtcccagcagcagaagatgcaaagtgggggacagtagaggtcagaagggagccagggcttgggcaagtgaaggagcaagacccggacccttcgagctccagaacattctctgcgtggccatgtgggttttacaccttaggagaaaattactcgaaagtttgtcaactgaaagaccgcattcattaatttatatttgttggttttgcttattgtattcaataaaacaagatgtttgcatgtagaaatataaagtgcccagaaaagtccacctgtgttttgttgtccgtaagtcgcgcttgggagcggggtggacctctgtctgctgcgctggaagcggagcagctctgcctccgtgtctaggcacttactcgtgggctgtctccgtgtctcgcgcaggtgcacatggggacacacatgtg

SEQ ID NO: 462225 - DNA, 3017 bp, Homo sapiens
atggcagtaaatatatcctggcatcatcatttttaatagctggatgtatattaagttaatcattgccaccccagagattcaggactttgtgaaggtgctgcgttccccacattggacaaatggaaggaaaagcaagaaagccagcaaaaccagggagagccctaaagaggcagttagagaagagtccacagatctggccagctgcctgcagtattcccagcagtttacgggagaattggaacgaactctctttgctctctccacgcagcagaagaacatggacagtgtgagtcctacagcctccctcatcccctggcagcccagcttcccagatggaggagttgaagctggttatgaagcccttgatgctaaccagcagttacagcaggccatggaggagcgggcacagctggaagtacacctggggcaggtaatggggtcactgaaacaactacagatggagaaagatcaacacgctgagaatctgaaaggagagagcgccttgtggtggcagaggatgcgggagatgtcagagcaggtgcacgcgttgagggaggagacggtgcatagcatgagtcgagtacaggagctggagacgatcttggctgaactaaggaaccagatggtcagcaacaggtatctgtgcggagggctctggatcatccgctaccctgaaggatctggaagtaagaggccctgggccatgacccaataccaagaggtaacagtcgccctggactcgagttatataacaatcagtcgacggaataaaaccatcgagtcattgatacccatgctccagcccttgccacacatgtcctggggttgtggcttctcagggaagcactggcctgattggttgtcaggagccccgtatttccactctgactcaggccctaatttgctctttgattctgggcaagccacctctcctccttgggcttgtgtttcccgaggaggaaaagcaagaaagccagcaaaaccggggagccctaaagaggcaattacagaagaggccgaggatctggccagccatctgctgtattcctggcagcatgtgggagagttggagcaggagcagaggaaggcagataggagtcagcctggggctgtgtcggctgctgtgggtgagttggggggtgctgtggggagcgagcactggatgcagagctcggaggccaagtgcctaccctgcccttacctggctgtggccttggtcaacaacagcaataaggagctgaagcaggagaactcagctttggcagagcagcttcaagttgtactgattgacaaggcagggatgcagtgtgacttggaggagctgaaaaagaaactggaactcactgagctcacgcttcaacagttatctagctggtgtgaagcccctgatgctaaccagcagttacagcagcccacagacgaacgggcacagctggaagcacacctggggcaggtgatggagtggctgaagtatctgcaaatggagagagagcagtatgccgagtatctgcatggagagagtgccatgtggtggcagaggatgcgggagatgtcagagcaggtgcacacgttgagggaggagagagtgcacagcatgagtcgagtacaggagctggagacgatcttggctgaactaaggaaccaggtggctgaacccctgcccccggagcctccagcagggccctccgaagtggagcagaagctacaagcagaggctgagcacctgtggaaggagctggagaatctggcaggacagcttcaagcccaagtggaagaaaatgagggcttgagtcacctgaaccaagagcaggaagaggttgctcaggttgttggagcaagaggagaagttgctggagcaagaggagaggttgctggagcaagaggagaggttgctggagcaagaggagaggctactggagctgcaggagagcctgctagagcagaagcggaaggccgcttcctttctcagctgaacccctacccggagcccccagcagggccctccgaggtggaggcgctcaggcataccgtgcggaacgaccgtaccaccatcaggcgcgcgctctcccagaaacacgaactgaagaagtatctgggcgagctgaaggagatggagcgcctggaagcagaaccagtagctacaggcccagttgagtctcatggctctccctggggaagtgccgaagaggagcaggcacagctacatgggcagctgaaggagcaaagggtgcactgccagcgcctgtcttacccggtggccttggcccagaaggagccagaggcagcagcctcagccccagggactgggggcgattctgtgtggggaaacccaccggaccttgcaggggaccatggggaagctgcaggtgagaaagtacgtcacatcataccagagccagaggtcagtgctgaagacgtggaccgggagaatgagtacataagcaggctggctcaggacaaggaggagatgaaggtgaagctgctggagctggtgttgcagcttgtgggcgactgcaacaagtggcatggcagattcctggcagctgcccagaaccctgctgatgagcctgctccatgggacccagccccccaggagattggggctgccaacaagcagggtgatctcccacagtgtggagcctgaacaagaagaggctggggagggttttccccacgacagccccacggcacagcagatcatgcggctgcttcatgagatgcagaacccccaggagcgcccaggcttgggcagcaacccctgcatccccattttttactgagctcaggagagcaagatgaaggtaacaatcatctaaaagccagccactgtcagcaaagcctggagaaatgggaccagagagtctgcccctaccacgtccctgccaccccttcccagttacccctttacccttacagtagcaaaataagacccctatctagtgagggagacaggtgcagatgaggtgaagatcactgtcatctaaaagcaggccaccaaatttaaaaaaaaaaagtta

SEQ ID NO: 462226 - DNA, 920 bp, Homo sapiens
cctcagctcctccttccctacacctgggactcttctgcgcagacttggcttcaaacaaggctcacggttcttcctggcatttgcttttttggcttagcgacactgtcttcagtctcctcacttgtccctttctcctctggcaagcgtaatgctatcaacatttgaaagtggcctgattccctggtgtctggtaaatggccttgctggtgaacttctttaggagaactgcaaagaaactagagcaggggctaaagagagctgctctcttggggctcagatgcccctcctggggccccacctcacactagcatctgttaaggagtgacctttgccaccaattaatgagggtgaggccccattcagttgcaaagaacgtggaattgtaaacaaacttgcaagtggaaagactagttccaggggaaatgtaggagggtagagtgacatggttaagagaatgtggttttttagatgggagatcagagaagacctctctggtaaggagacatttgagtcaaaatctgaagaaggagggagtgagtcatctgagtctgtgaagaattttctaagcaaggcgagcagcaagcacgaaggctctcaggaaggagtgtgcttggtgagttctaagaacaagcaggccagtgtagctggaaagtattatatcaaccaggagctctgggatgcgggactcagccagcccaaggaaggtgaatctggattctttaggccaatcatgaaaattttctactcttgccagtccaggacctacgaactcagcagccttgagcaagtcactggaccattcagaacatctgtttctctcttgtggaatggagataataatacctgtttcacaaggcaattaagaggatcgagtgaaatatgtgaaaatattgtttaaaacttaatctcaaaatgtgacc

SEQ ID NO: 462227 - DNA, 623 bp, Homo sapiens
cctcagctcctccttccctacacctgggactcttctgcgcagacttggcttcaaacaaggctcacggttcttcctggcatttgcttttttggcttagcgacactgtcttcagtctcctcacttgtccctttctcctctggcaagcgtaatgctatcaacatttgaaagtggcctgattccctggtgtctggtaaatggccttgctggtgaacttctttaggagaactgcaaagaaactagagcaggggctaaagagagctgctctcttggggctcagatgcccctcctggggccccacctcacactagcatctgttaaggagtgacctttgccaccaattaatgagggtgaggccccattcagttgcaaagaacgtggaattgtaaacaaacttgcaagtggaaagactagttccaggggaaatgtagcagccctagcaaaccaagagtgagccaccttggaagtagatcctgcagtcccagtcaagccttcggatgactgaaacttcggccaattatctgactgccatcagagaacccaagccagaactacccagctaagctacttttaaattcctgacccacagaaactatgtgaattaataaatgtttcttcttatttta

SEQ ID NO: 462228 - DNA, 3188 bp, Homo sapiens
tgagggcacctggttaatatctaactgcaatctcgcctccagcctggctcgcagttctgtgaacccggtgaggaggctgcacggtgatgacaggtcaccaggcagactcgtgtgtggggtttgtgtgtgggaggagttgtggtctgtgtggtcccctgtcccttctttcttcccaagggtgacccgttcgccttcgagtcttccaaagatgtgggcagcagggtctcaagtccaccactgtgttctctcatcctaactcctcctagggccgacagaaaatcccttggcttccagagccttcctcaggctttctctcctcaattcacagcaactttatgaactccttgtcccccagtttatttttcaaacagaggctagtattttaattgtcattttgtttatacatagcaatatatggctctttgtaaaaggttttgtgtttgtgaacatttcacatgagaggaagcagagaaaaaccaccagacatttcgctgtaaaaaaaatgaatattaataaataaaatctttgttactgtcctcccttcatcatccctagacagagacaccttttgagaatgtctttggattaagtttcctctttggaaacgttacagagtgatgagtccccagcccatcctctatggtttcctggtcctgggtttcagagctgcctggggccaccccaagatgcccacagctgccaagtctcttgtagtgtcaaaagacaagtgtgagccttctgttatgcctggacagggccaccagggggctccttggtctagcagtgacgccagcgtctgggaagacgcccgttgccaggcggtccgtggtctagcggtagcaaaaagtgtcaaggaacacccactacttagcagaccgggaaagggagtctccttttccccgggggagtttagagaagactgctcctccacctcttgtggagggcctgacatcagtcaggactcagtggcatttgaggatgtggctataaacttcacctgtgaggagtgggctttgctgggtccatcacagaagagtctctacagagatgtgatgcaggaaaccatcagaaacctggactgtataggaatgatatggcaaaatcatgatatagaagaagatcagtacaaagatctcagaagaaatctaagatgtcatatggtagagagagcctgtgaaattaaagataatagtcaatgtggaggaccctttacccagactcaagacagtattgtgaacgagaaaatacctggagtagatccatgggaaagcagtgagtgtacagacgtcctcatgggtcgttcatctcttaattgctacgttagagttgacagtgaacacaaaccatgtgagtatcaagaatatggagagaagccatatacacatacacaatgtgggacagctttcagttatcagccctgctttcaaatacatgaaagacctcagcatggaaagaaactctatgattgtaaggaatgtgcaagcttcagttctcttgaaaaccttcaaagacacatggcagcacaccatggagatggacctcgtatatgtaagttgtgtggaaacgcctttatttggcctagtttatttcatatgcttagaagaactcacactgaagagaaaccatatgaatatgagcagtgttctacagcgtttcctgcttatagttccactctaagacatgaaagaacacacagtggagagaaaccctatcaatgtaaacaatgtgggaaagccttcagttgttcctgttacactcaactatatgaaaggactcacactggagaacaatcctatgaatgtaagcaatgtgggaaagcattttatcatcttggaagctttcaaagacacatgatagtgcacactggagatgggcctcataaatgtaagatatgtggaaaaggctttctttctcccagttcagttcgaagacataaaagaactcacactggagagaaaccgtatgaatgtaagtattgtgggaaagcattctctgattgcacaggttttcgaagacacatgataacgcacactggagatggacctcataaatgcaaggtatgtgggaaagcctttgattctcccagtttatgtcgaaggcatgaaacaactcatactggggagaaaccctataaatgtgaatgtgggaaagcctttagtgatttctattactttcgaaatcatgaaactactcacactggagagaagccatataaatgtaaacaatgtggaaaagccttcatttccttcaggtcttccaattacattcgagtacatgaaaagactcacactggagaaaagccctatgaatgtaagcagtgtggaaaagcactttctcatctgaaaagctttcagagacacatgataatgcacactggagatggacctcataaatgtaagatatgtgggaaaagctttgattctcccagttcatttcgaagacatgaaagaattcacactggggagagaccctataagtgtaaactatgtgggaaaggcttcaggtcttccagttacattcaactacatgaaaggactcacactggagagaaaccctatggttgtcagcaatgtgggaaagcattatctgatctctcaagctttcgaagacacatgataacacatactggaaatggacctcataaatgtaagatatgtgggaaaggctttgattatcccagttcagtgcaaagacatgaaagaactcacactggagagaaaccctatgaatgcaaggaatgtggtaaagccttcagtcattcaagttacttacgaatacacgaaagagttcatactggagagaagccgtataaatgtaaggaatgtgggaaaccattccattgtcccagtgcctttcataaacatgaaaggacccacatacgtgtacatgtcagcaacaatgtcaggatctgtggagtttgcgagtataagatctttaagtgttgaaggtttcatctccataattgcagctgctttagctacaaatattataggaagctgttccttctttttctttacatcaccaaaccttccagtggttataggcattttgttatccttcaagtgacctggagcctttgttgcatgacaggattgtacctgaagatcacattctttaacaattggacctactgaatctgtaaaactactagaagaaaacatattgaaaatacttcaggacattggttt

SEQ ID NO: 462229 - DNA, 1022 bp, Homo sapiens
cagataacattcagagtacgagttctcatatccagcatcgtccaagcgggagttgatgtgctctccgagttctagatgagaaagctgcgggctgctggcggtgtggagagtgactgaaggtgcaagctgcatgtcgggggagctggcggtgtggagagtgactgaaggtgcgggctgcatgtcgggggagctggcggtgtgcagagtgactgaaggtgcgggctgcatgtcgggggagctggcggtgtgcagagtgactgaaggtgcgggctgcatgtcgggggagctggcggtgtgcagagtgactgaaggtgcgggctgcatgtcgggggagctggcggtgtgcagagtgactgaaggtgcgggctgcatgtcgggggagctggcggtgtgcacagtgactgaaggtgcaagctgcatgtcgggggagccggcggtgtgcagagtgactgaaggtgcacgctgcatgtcgggggagccggcggtgtggagagtgactgaaggtgcaggctgcatgtcgggggagctggcggtgtggagagtgactgaaggtgcaggctgcatgtcgggggagctggcggtgtggagagtgactgaaggtgcaggctgcatgtcgggggagctggcggtgtgcacagtgactgaaggtgcaggctgcatgtcgggggagctggcggtgtgcagagtgactgaaggtccatgttgcgtgtcgggggagctggcggtgtgcagagtgactgaaggtccatgctgcatatcgggggagtgcattcggagtgttctcatctgtctcatccctgaccacgtgagtacgcaggacacctgtgtctgtgttaagggagttcgttcctaagtgctctcatctgcctacttccatgactgtgtgagtaaaaagggctcaggtcacacacaagaaggaagaaattggaaacccaggaacacatatcagaggaaaccaactgaaaacaaataataaaatgcagacgtacgttctaatggtctaaatacgagacagaatggat

SEQ ID NO: 462230 - DNA, 1565 bp, Homo sapiens
ggtgtcttgcagtgctctgccagctgtggtaaaggggtgtggaaacggaccgtggcgtgcaccaactcacaagggaaatgcgacgcatccacgaggccgagagccgaggaggcctgcgaggactactcaggctgctacgagtggaaaactggggactggtctacgtgctcgtcgacctgcgggaagggcctgcagtcccgggtggtgcagtgcatgcacaaggtcacagggcgccacggcagcgagtgccccgccctctcgaagcctgccccctacagacagtgctaccaggaggtctgcaacgacaggatcaacgccaacaccatcacctccccccgccttgctgctctgacctacaaatgcacacgagaccagtggacggtatattgccgggtcatccgagaaaagaacctctgccaggacatgcggtggtaccagcgctgctgccagacctgcagggacttctatgcaaacaagatgcgccagccaccgccgagctcgtgacacgcagtcccaagggtcgctcaaagctcagactcaggtctgaaagccacccacccgcaagcctaccagccttgtggccacgcccccacccggctgccacaagaatccaactgcatagaacatgagcgtggacttggcgtttgccattagtgcttccgtacttaatatattgttaacagccactggctcactttctacagtgaggagaaagtaggcatgagtcacaaagtaacttcaatttctaggatttcaggtacctcgaagggaagcacctctggcagacaaccgtcaagagagagacatcatttagtgttcctgtcttgactcgcttttgacatttgaatttccagtgcttggtatatcatggaggaaacatccccaaaacgagacatgctagaaaaggctttattctaaaggctttattctgaaagccggcgacaccctggagggaggggcaggtgttggtgagcctctgcccgtggcttctctggggagggccgggctgcttagcccacgtttctcttcatctaccttcttgaccacatgagaaccaggacattgcctccatgcccgtctctgacaacatagtctctaaatcctaggtgttgccttggaagtctcgtgcgtggagtgtaaatctatatatgccagcgaggacagcagtgccacgcagttcataccacccgcatgggaagaatgttccaagagagtctgggtttggggaagcatctaattttcagagctctgctgtccaccgtgtagggaaacagaagggcctctcttcaaggtgctgtgacataagaaacggtaattgcggtgatggggttgcttcctaaggcaaagagatgctgtaccacatcccagtggctttctaccgaccgtggccatttatctgaagatgctgatcacagcagtgatgtttctgtgttaataccctgtactgtccctcgagtactgtacctttgtgcttgcacacgtgtcactaacgcacgtgttaccagagtctcacgaccctacggtgctatttttattggtgcaaaattaaaccctctcagctgacc

SEQ ID NO: 462231 - DNA, 1122 bp, Homo sapiens
ctttccatctccttgctgggctaagaaaaggattctgatcatgatggccaggaagatggcaatgatttcctggtacgctgtagtagttgctgttaacgctgttggtactcttcccccttgtatcatcttagctgtcaccatttctgcacacatcaatctgacagcttccaaccatgaacacctatgtctctttgagcgctttctctatctgagtaaaaacatccgtggggtgctagacaagatcagtgcctgggagactcgggagactcaaaaccgggacatgaacaagagtactctcgaaagaccatatgcaaattccctctctccaacccatcacctaatgcttgttgatgttctcatgggttcagtaagttatatcacagaatccactgtctattcaatggctgcccaatatgaacgtggagttttaatggaacaggtttttgtttgggggccccacttctctagcgttacaggtgtgccttcttctacacataaatctactgatactattactgagctgaatttaggtctgcctgctcagtgcagaaaagccaaacactgacattgagatctgcagcgagagaaaccaatcagcagggcttatctacctattcacaggaattggttcagggacagacctagccgactgctggagccagctcccaggggcttcagagagtccactgcaggcccctctaccgcacgctgggtccagggacatcgcattggtagtttgaaatcagccatgacagggagagagcattgctagacattcatctgtacactacctggatgaacaagacctaatttaggtccatgagacgtgaggagatatttaatcagggtttggagaaaccatggaagaagagtctattcttttgtgtagggagagttataaagaaattggatgtgagactactaaagccattttggccatcaaaggacctaaccagaggacagagttgacacacagagaagagatgctctgaaaggatcaaagaggtctggagtcagagcgctgagggtgtggacttctgaatccacccccaaagcccgtatgcctcttcactcttcagttaaatgagccaataaagtccctgttttaaaaccagtttgaat

SEQ ID NO: 462232 - DNA, 1168 bp, Homo sapiens
gcaagaaatgttaaaagaagtgctttagagagcagggaaattctataggtcagacacttggatctacataaaaaaaggaagaaaccaaaggagaaataagtgaaggcatggaaaccttgttccacacattgcctggtgccctgtccagcgctgcaaggtgcactgcgtctcctctgcccagcaagccacaagcccctccagggtgagaggagagccttcccttcccttggtcctcccttcgacacagggagctggagctggacagccccataggcactcagggcttgaagaagatatctagaaatgtcaaagcagaagagcctcggagataatctgaactatttctgagtttatataagggaaaactgagactggagagaactaacatgtctaatattacaatggaaacttgtaataaaaccacaaattgagtcaagtctcctgattcactatatgagcttcttttgactctaagaaactgtccttcacaaagttcccaagaaagaatggattggccagatcgatagaggaatttctgaggaaactgcacttgtgtttttatatacttggcacttattcatgctaaacagtagtttagtgcagtggtggagaaaagaatccctttgaatgatacctgattaatgtgtgtataaagcacacaggcctataaaatagtgtggaatatgggacaagctatcttgatgccaagccatggaatggacctgtgtaataagtctacactctttcttctgagcctcgagctgcccctggagtttagacaattatcttcctttgaggatttgagaaaagttttcaaattgcgacaatttagggggattttattttttattttattcttatttctcactccttacttcttcctgcacttggaatcgttaacttgtgctgagtgtggccgccaggccatcactgctagaaaggacgagagattcttagcagtagtcagagagcacccgtcgggaccagtccttctaattctcaaaccaaatgaggttgaacaaacccggcccccaccagttggtccttttgttacaactgatgaactgcactaacacatcaccatcacccagaatccatagtttacgtaagggttcgctcttggtgttgtgcattctacgagtttagatcaatgcataatggcatgtat

SEQ ID NO: 462233 - DNA, 439 bp, Homo sapiens
gcaagaaatgttaaaagaagtgctttagagagcagggaaattctataggtcagacacttggatctacataaaaaaaggaagaaaccaaaggagaaataagtgaaggtaaagtaaaaattttatttttcttacaacaaatacatttattcaaaataaaaatagcaaaaatgtatttgattatgtatgtgtttttgtatacatgcatacataatcaatatagtcatgtgtatacagacacatataatcaatatagttatgtgtctcttaacaatgaggatactttttgagaaatgagtcagtaggtgattttgtcattgtgtgaacatcatagtgtgtacttatacaaatctagatagtatagcctactgtacacctaggctatttattatagcttattgcttctaacctacaattctgtacagcaatacagtattataat

SEQ ID NO: 462234 - DNA, 797 bp, Homo sapiens
tgatgtttgagaacctccacctagatttcagaagatgtatggatgcccagacagaagtttgctgtagggggcactgcagaaggcaaatatggggtcagagctcccacacagtgtccctactgggcaccacctagtggagctgtgaaaagacagccaacttcctccagtccccagaatggtagatccactgacagcttacactgtgagcctggaaaagcttccaacactcaacaccagcctgtgaaagcagctgggagggaggctgtagcctgcaaagccacagggctggagctgcccaagaccatggaaaccctcctctttcatcagcgtgacctggataaagaaattatcaatggttctgctgagaatgcaggtgtggatattttaaaccaggctggcaacattctgagagcaagaaagcgcagaggactgaagaatctcaccacaaaccttctggagtctgaaccagcaacgtagcacacaatatactacaaaactccttctcatgtcctctcactccagcacttccattctccccaccaatggccctatttgtttactgccatgttgctgttgcgtttcacaaggttgctgatttcttctccaaagatttgtttcccgggggcctcccagtgttgtagaacctacagtgtatgacttggaggagtcaatgagatttcctctccattctaatcacatataagtctcgcttgttgcccaggctggaatgcagtgcagtggtgtgatctcggctcactgaaacctccggcaacctccacctcccgagttcaagcaat

SEQ ID NO: 462235 - DNA, 1790 bp, Homo sapiens
tctgctctagtcctggagccctaggaaggcttccctggattagaaaactgaggcccagagaaggaaagtagctgccagaggtcacacagctaggattgagggatcagagactgctgcagcccagatgccttcgcagccatggcctggcccatccaacccgctgacctcattcccagctcccctctcttgcaagctccccccttgcctgccacggtcctgggtctccagctgccccagttgaacagggggctgtcccctgcggctctcaaggcgttccggggctggctcagctttgtcagactgggaatctgcccaagtgtccttctgaagggccctccccgcattcgaggctggatctggcagaaaagctggagaggctctgctgcccgctccagggatgacacgtctctgctgggtggggagtccacgtccgcagaaaagggggaggccacgtgtctggacccttcccgcagagcccctgtgccctgcaaggctgcctgccacccccctccttctctccctcctctccccagcagccctggcctgccccctccctctgatctcaagaaatagctggggggtcgggggaggggacactgaagggaagaccaagctaggaaaagctcctctccaccccctcccagcatgtctgggcatttcactccccaccaatgagcctcagtttcctcaactggaaaataagggggatgaacagaaaaagtctctacccatggagttcctcctcccccacaagctggcacatgtggatattggctctgttttgcctttgacccctagtgaaagaaaatactgagctggtagacccctgtggggacaacagatcagagcttggtcaccaatatggacatctaggtctgagcagggcccactccccgggggcgcatcagctccatcccggcaccctttacactggccttctcttcacaaaggaccacaggtcatcctcaagccttcctcccaggctatccttgtccctgaatactaatgtctaaaggtcagcccagctaccagcagtgtgcatgtgatgtgtcccatctccccttcggattggaggaagaagctgtgtccctcccatcagacagacggtctccttaaagattctcctggtctccagcttgggctctgctggaaagaagaggaagtatttagcaagggtgaagatgggttcttacttccctgaggcaaccagagataagaaaagaccagaatatgaatatccagcattccacaaagaatcctacaggcagggatattgcccaatcaccagtgcctcgcatcccagttctatccaagatccaagcttgatatcctcctgaaagacttcctgaatcaggtcaccaacatggacatctgaacttccagaatcaggtcaccgtctttcttctcatctctggatgtatttggagctcatttgtctgacggtttttgaatgctatcttttaaaaataaacttttacaatttgggtttaataattctagatttatagaaaagttgaaaagaaagtacagaaagttcccatatatcccttatccagttctcttaatgttaacctcctacatcatcatggaacatttgccaaaatgaagatgtcaacactggtgctttgctgtgaactaaactccagactttattcggatttcatgaatttttctcctaaggtcccttttccgttccggcattccacccaggatatcacattgcatttggtgtttgtgtctccttggtctcctctggttcttgagagtttctcagtctctccttgtttttc

SEQ ID NO: 462236 - DNA, 3191 bp, Homo sapiens
accgttggctctcgctgcacgcggaggtcaaggtgtcgtccttactgctgtgtgtcgtccgctcctaaaggcccagcttctatggccctgtgacctgcaggtattgggagattcacaactaagtcgccaggacccccggaagcctagaaatgggatcgttgacatttcgggatgtggccatacaattctctctggaggagtggcaatgcctggacactgcacagcagaatttatataggaatgtgatgttagagaactacagaaacctggtcttcctgggtattgctgcccctaagccagacctgatcatttttctggagcaaggaaaagagccctggaatatgaagagacatgagctggtgaaagaaccgccagttatatgttctcattttgctcaagacctttggccagagcagggcagagaagattctttccaaaaagtgatattgagaagatatgaaaaatgtggacatgagaatttacagttaaaaattggttgtaccaatgtggatgagtgtaaggtgcacaaaaaaggttataataagcttaaccagagtttgacaactacacaaagcaaagtatttcaatgtggcaaatatgcaaacatctttcataaatgttcaaattcaaaaagacataagataaggcatactggaaagaaacttttgaaatgtaaagaatatgtcagatcattttgcatgctttcacacctatctcaacataaaagaatttatactagagagaattcctacaaaagtgaagaacatggcaaagcctttaactggtcctcagcccttacttataagagaattcatactggagagaaaccctgcaaatgtgaagaatgtggcaaagcctttagtaagttctcaatccttactaagcataaggtaattcatactggagagaaacattacaaatgtgaagaatgtggcaaagccttcacccggtcctcaagccttattgaacataagagaagtcatgctggagagaaaccctacaaatgtgaagaatgtggcaaagcctttagtaaggcctcaacccttactgcacataagacaattcatgctggagagaaaccctacaaatgtgaagaatgtggcaaagctttcaaccggtcctcaaaccttatggaacataagagaattcatactggagagaagccctgcaaatgtgaagaatgtggcaaagcctttggtaacttctcaacccttactaaacataaggtaattcatactggagagaaaccctacaaatgtgaagaatgtggcaaagccttcagctggccctcaagccttactgaacacaagagaattcatgctggagacaaaccttacaaatgtgaagaatgtggcaaaacctttaagtggtcctcaacacttactaaacataagataattcatactggagagaaaccctacaaatgtgaagaatgtggcaaagcctttactacattttcgagccttactaaacataaagtaattcatactggagagaaacactacaaatgtgaagaatgtggcaaagtcttcagctggtcctcaagccttactacacataaggcaattcatgctggagagaaactctacaaatgtgaagaatgtggcaaagcctttaagtggtcctcaaaccttatggaacataagagaattcatactggagagaaaccctacaaatgtgaagaatgtggcaaagccttcagtaaggttgcaaaccttactaaacataaggtaattcatactggagagaaacaatacaaatgtgaagaatgtggcaaagccttcatctggtcctcaagacttagtgaacataagagaattcatactggagagaaaccctacaaatgtgaagaatgtggcaaagcctttagctgggtctcagtccttaacaaacataagaaaattcatgctggaaagaaattctacaaatgtgaagaatgtggtaaagacttcaaccaatcctcacaccttactactcataagagaattcatactggaggaaaaaccctacaaatgtgaaaaatgtggcaaagctttcaattagttcttaacccttactgaacataagggtatttatacaggagggaaaccctacaaatgtgaagaatgtggcaaattttttaactgttcctcaatccttactaaacataaggtaattcatactggagggaattcctacaattgtgtggaatgtggcaaagcctttaatcagtccttaaggcttactacgtacaagacaactcatactggagagaaaccatacacgtgtgaagaatgtgggaaagcctctaacagatcctcaattcttaacagacataagctaattcatactagagagaaactgcaaacctgaaagatgtgacaaggcttttggcaacacctgaaacttttctgaatataaaagaaatcatactggtgagaaatcctagaaatgtgaagaatgtgacaaagcctttatatggctgtcacacttgattgtaggtttttagcttctttgcaatgggtttgaacatgctcctttagctcagagaagtttgttactaccgaccttcagaagcctaacttctgtcaactcatcaaagtcattctccattcaactttgttccattgctggaaaaatgtagatttttatgccttcttgtaattttttattaaaaaattttaccgtttttacacacattgcctgcaaatccatttttagtagtctcaatacatgttataatggtaactttatgtaattttaactttaatgtaaaacctgtgtggcctatggtggaaggaaatagaaaaagggcataccacttctcgaccttcctttttttcctctgggtcccagcaaccatcatagatgttacccatggatgcaagcatgaccttcccccatgggtccggaggagtttgtcagcaggacacgttatgctcaccttctcacctagctttccatgctgctggttttctaggcccactcagcccaaaaggctctcaaggtaaacactgtataagttcattttatctttacacatatttgcatgtgtatatgtgattttatggacctttagaaatagtattgcatgtgtgtttcctggatgacaccgtgtgttcaatggttagaagagcaggctcagagtacctgtgtaaccttgggcaagtctctcgacttctctgactcatttgttactcagggataataac

SEQ ID NO: 462237 - DNA, 1694 bp, Homo sapiens
ccgggccagtgcgggagccggagcggagccggggccggagcgggcggaatggagcccctgcgcgcgcccgcgctgcgccgcctgctgccgccgctgctgctcctgctgctgtcactgcccccccgcgcccgggccaagtacgtgcggggcaacctcagttccaaggaggtgagcatgccgagccctcctctgcggcccgccggcccccgggggacgcaagggaggcgaggggagcgggtaccgcctcgccccctgccgcccctcctggcggactccgggagcctcgggggagtggggccgagggcgatgggggactgggccagagtcgaggctaaggggagccgtagggtcgcggccagacctgggggttgtaggagggacgttgaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcagtgcgtgaacggtggtggtatattgcgctcagcaagtgtgggggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggattcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggggccgcatcagccacgcgggctccgtgaagttgtctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctggttctttgcggttcctgtcatggccctgattgccaatttcggcatccccaagtgggcccgggagaagattgtcaatggcatccagctggggatccacttgtacgcccatggcgtgtttctggttctcctgcctcagcctccggagtagctgggactacaggagcacgccaccatgcccgtagagacggggtttcactatgttggccaggatggtctcgatctcctgacctcatgatccgcccgcctcggcctcccaaagtgctgggattacaggagtgagccactgcgcctggcccccaccacgtctattctttgccctggttcacatcctatctgacattcttggtgacagttctaatattcattaatttattcatcaat

SEQ ID NO: 462238 - DNA, 3890 bp, Homo sapiens
tctttatcctcatcgtcttcacgttgagcaggctaaggtggaagacgacgaggggttggtcttgctgtctcaagtggcagagaagttgctaaccattgtgtggctggactcggccgccactatggtgtgaggcgcgtgttcgggctcttgccgtccccgcacccgcaccgcggctactggcttgcggtccgccgttccacaaccagcccttgggcccccgcccgccacggacatgccgcgcgtctacataggacgcctaagctacaacgtccaggagaaggccatccagcgctttttcagtggctatggccgcctcctcgaagtagacctcaaaaatggctacggcttcgtggagttcgaggactcccgcgacaccgacgacgccctttacgagctgaacagcgaggagctctgcggcgagcgcgtgatcgtagagcacgcccggggcccgcgtcgcaatcgcgacagctacagctacggaagccgccgtggtggaggtggatacagcagtcggagacatctggcagagacaaatacggaccacctgtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatatcgaagcaggtctcgatctcgctcaaagtcaagatcaaggtccaggtcgagttccagggattaactcagaactctcttgttgtctgcacactattatggaacactttcctgcttaggcagttactcttccatgtttatacttggtctcttctgcaagaggaatctcttgaaaacaggggcacacagaaatttgatatgtggccaaattggatgaaaaagatgaggtttaaggaaatggtggcatgaagaccctctcccttctttgtagaattaagataactatgattttatagcttttgagctaacataacttttgtaaagattaagctcatttagtttttgtttgtttgtttgtttgttttaagtatttcagccagatctgctggcagggtttttttgttgttttatttgtttgcttatttttaaattaactgttttgagctttgaatgcttaaggctttagagggagaacccaattttcaattatgttggctttttataaagcttgagttatgtaagatttaaatagaagtttgctaccaagatgattgccttattgaataggtcactattaaattcctttaaatgttgatatctgccatttgtggaaacaacgtaaattctactttagtgtaaacaaggcaagcctcagaccagcaataaattattcagtttggataacattattttgtgctgttaatcaaatttgccaaagtctttatctgcccctttaacaagttgagtaaaaataaaaggtatttaaaaaaaaaaaaggaagttactatattttttcaattgtagaagttttgttagattagtactatgcatttgatgtttttgatgtataaatgctattattttaatttcattttctgattgttgccacaatataggtatatggtatatctcattcatatatatatatatatatatatatatatatatatatatatatgtatatggaatagattttttaaagttgatcttatatccagtgaccttgctaaattcacttatttataattgttcattctttttgactttctgtgtacacagtatgtcatctgtggtaaagtcagttttacatcattctttataatcctcataccacttttttcttgctttattgcactggctaggacctccagaaataggatttgtagacatccttgcctttttcccagaatctaaaggaaaacaaaacattttaccatttgcataatgtcctcaagattcatctatacaaattgatttttagatattaaagcaatttgcattcctggaatagatttcatttggtcattgtgggtaatatttttaatatattattgaattaaatttgtcaaaattttgtataggattttatgtctatgtccatattgtcttctgtgttttctttcttgtaatagccttgtttgactttgtatcagaattatggactcataacatgagttgaggattccctttattttgtttttggttttttgtttgtttttggtcctctggaagagtgtgggtaagatgtgtaagattggtattattggttttggtattattttgccataattttgtgtgtaaaaattaccagagtagcacctgggaaaatttttagctatgtagtcaatgatttgatagacataggattaatcaaattttatatctcttgtgtacattttggtaaattcttttaaaaattatgtccatataatttcaccaaaatatctaattactggttttaaatagtttataatatctgttctatttttaatatctttaggatctaaagtgatgttcccttcttcagtcctggtgttggtaatgtatgtactctgttttcttgattaggttttctaggacttaacatttaattttttttaaaaacccacctacttttatagagctaatttctttttcactaatttatgctcctttattttcttctaaatattttatttggatatgattttctggggttttttttctagcttcttggaatgaaatcttagataagcaatgttcaacaattcttttttgctaataattgtatttaacgctatacgtttctttaaagtacctatttagctgtatcaaatagatttttatcacctttattgagacataaatgatatataacaatttgtacccagtttaactttacattttgataagttttggcaaacttatacacctgtgtagccaccaccacaatcaaacaacattttcctcacccccaaaatttcctgcattctttcccagacaatgcttcccacctctgtctccaagaaatcataaatctagtttttgtcagtatagattagaattatcttttctagactttcatataaatggaatgatacagcatactcttctgtgtctgccttctttctcttaacataaagttttgagatccgttaatatggtgtgtatcagtgtttcattctcttattgctgagtagcatactgttatgttaatatatgaccacaactgattaactcactcgatgatggacagttgtttccagtttggggttatgatgaataaatctgctatgaacagtcatatacaactttttgtgtagacatatatttttttcatttatattgcatcaatttctgggtttggagttgctagttcatatgataaatatatgtaaaactttataagaaactgccaattgttttccaaagtatttgtaccattttacaaccccccaacaatgtatgattgtttgagatggctcttacggttttctgtatctcccattcttctctatctatctgcatcaacctggatactttccacttacctgtatttctgttattatcctgtttttaatctattaaaaccatattttgaattattcattttactcagatgttttatttctggaatcttagtcttctttttatatggattctatttatttgctaaaattcttcattcttttttctcttttgaatatattatttattttaaataatatttatttaaaaatccttgagtgttaactgcaatagatgaattgcttctgggtctgttgctatctggccaattgatgctttcttttcccctgcatgacttctaatatttcatttgatggcaaacattatacttgaaaaaattatagatgttcctgacttatgttcctctaaatagagctaagtcttattttagcagatggttagaataccagtagatcacgctgatc

SEQ ID NO: 462239 - DNA, 1019 bp, Homo sapiens
tttgaacaaagaatcggacaaaatgcacagcaaacaaggaaggaataagcaacaaaagcagcgatttattgaaaatgaaagtacattctacaaggtgggagcaggcctaagcagtggctcaagagccccggttacagaatcttctggggtccaactaccccctagaggtttcccattggccactggtgtccaccccatgcaaatgaagtggtggccctcaatcaatctgattggttgcagaaagcaaccatcagaggctaacatgaagttacaaagttacactcctatgcaaccatctgattggttttggaaagcagccaatcagaggttgaggccctggaaaggaaaacgagatctgagggatccaaagccaggcaacatgcgcaatgtaaatgggcaggatcaattcctgccaacaaaaaccctgcttcatggaagaaggccatgctccatggcatagatatgaacttgttatgatatttctgaagaagaagagactgtaaggaagacctctcctaacttagcaaccattctccattttccaaaagggtaaaccaaggcacagaaagataggcacaaggtaacttatgcatgcagaaggtaacaaacactcgtgcacacacactgaaaatcagaaagagagagagagagagagttgccataattagtacttttgtttagagaagaaaggctgaagcctggagaagttaagcaacatgcttaaatccacacagctagtcagaggcaaagccaagatttgaacgtgggtagtctgaatccaggatcttggccttcacccctctataacatgacaccctcatccctgaaaaaagaaaaagtcaaccgaaagcattgtgaaaagtgtcctctaataaaatggctaattctggcaacaggcccagagaggggatggagaaatccacttagttttactttcatgactgatacatatcttaaaactgagtttcttgctggaagattttttaaatcttattgtaaagacctaggaacttaaaact

SEQ ID NO: 462240 - DNA, 528 bp, Homo sapiens
cggttgctgaaggaaagagctattaccaaaacctatactttctgttttcaattttttcatttcttcttgggttctggggttttttccaggtaacttatgcatgcagaaggtaacaaacactcgtgcacacacactgaaaatcagaaagagagagagagagagagttgccataattagtacttttgtttagagaagaaaggctgaagcctggagaagttaagcaacatgcttaaatccacacagctagtcagaggcaaagccaagatttgaacgtgggtagtctgaatccaggatcttggccttcacccctctataacatgacaccctcatccctgaaaaaagaaaaagtcaaccgaaagcattgtgaaaagtgtcctctaataaaatggctaattctggcaacaggcccagagaggggatggagaaatccacttagttttactttcatgactgatacatatcttaaaactgagtttcttgctggaagattttttaaatcttattgtaaagacctaggaacttaaaact

SEQ ID NO: 462241 - DNA, 1748 bp, Homo sapiens
tgcggaaacatggctcgcgaaggactgcggaccctcgtggttgcaaagaaggcgttgacagaggagcagtaccaggactttgagcccatgcagtccagctctgtggagtccacacacagcacgtacacgtgtgcacacaggcgcctccccctctgtccccagagccgatacactcaagccaagctgagcatgcacgacaggtccctcaaggtggccgcggtagtcgagagcctggagagggagatggaactgctgtgcctcaccggcgtggaggaccagctgcaggcagacgtgcggcccacgctggagatgctgcgcaacgccgggatcaagatatggatgctaacaggcgataaactcgagacagctacctgcattgccaaaagttcacatctcgtgtctagaacacaagatattcatattttcagacaggtaaccagtcggggagaggcacatttggagctgaatgcatttcgaaggaagcatgattgtgcactagtcatatctggggactctctggaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgatggaggaaatgatgtcagcatgattcaggcagcagactgtgggattgggattgagggaaagcgtacgctcggtcagcaaacactcagcacatgcttggtcaacacacatcagcacgtgctcagcgcacagtcagcacacactcggtacacgctcggtcggcgcacgtcagcacatgctcagcgcacagcacacactcggcacacggtcatcacacgtcagcttgtgcccagcgcacagtcagcacacactcagcacacggtcagcgcacatcagcacgtgctcagcgcacagtcagcacacagcacacactcggtcagcgcacgtcagcatgtgctcagcgcacagtcagcacacacggcacatacgtgcttagtgcacatcagcacatgctcagcacacacttggcacactcgtttagcacactacacatgctcagcacacgggcgggcccacactcagatcacaagggagtccttcaacagggctggcccggactctgcagctctgctgactcctgtgacacctatggagggtaaacaggcctcgctggcggccgacttctccatcacgcagttccggcacataggcaggctgctcatggtgcacgggcggaacagctacaagaggtcggcggcactcggccagttcgtcatgcacaggggccttatcatctccaccatgcaggtgctcgtggaactgacagttgtcttcgtctgtgggctctctctccaggctgtgttttcctcagtcttctacttcgcatccgtccctttgtatcagggcttcctcatggtggggtaagttacactcagaacctgccagctcatccaggggaggacttctattttgaaaaaaaaaaaaaaaaaaaaacaaaaaacgtatatagaagattcttgatacagtcatcatttagaatgaataatactgatgtaaaaacaacattttacttgggtgaacttcaagacagcacctgcacacttgttcctcctgggattttcttattagattttgttttcaagtggaagccatagtttgtgtcaggaactgtgttggatctgagatttttaaagggtccc

SEQ ID NO: 462242 - DNA, 3471 bp, Homo sapiens
tgcagatgtggcatggccaaaaaatcccaggtttgatggaacgaaggagcggggaaaatcccttgagtgaggaagacgctagtgttctcttatatctgtagcaagtctggctgaaatgcaaatatccaataatcagagtacaggaagcacctcgcccttagagaagctgtggctagaatccgtcaagtcagtctggctctgccgggcctgatacccaaggcttccgctgtcactcagaagtgaggggcggggcctagcattccatccaatcagaggtgccggggcagggccctgcccattgtttatccaggcacagagtgggtcgcattcctgtcctcacctttgtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacctgaaaaatcttacactggagagaaaccctatgagtgtaagcaatgtggcctccagctgcccagaacagctgcagagagtgtggattctgagaagctgcagggccctggaaagcaggagacccacgtgcaggatgccctatccaatcggggtgctggggcggggccctgccaactgtttaatccgccggaaggagggcgcagcattgccggtcttctcattgcctggctgctagaggaaacccgaagtcgggattctttctttcctgctctgagagggaccaggtccctcctccgtagcttttgtctctctattgcctgcgccgtgtcctggactgctcacgggagttctgcaggagacgccggaatatctggaagctgaaaaatggaaataaatggaaagaccagaatattgaagatcactacagaaatctaagggtcaggcatggtggctcacacctgtaatcccagcactttgggaagcagaggcagttggatcacttgaacctgggaggcgttctggaggtcaggagttcgagaccagcttggccaacatggtgaaaccctgtgtctgctaaaaatacaaaaattagccgggcctcatggcacatgcctgtaatcccagctactctggaggctgaagcaggagaatcgcttgaacctgggaggcggaggttgcagtgagccgagatcacgccactgcttcttgctttaaaagaagagtaaagacaagagtgttggaccagtattgcagttctgtagtatcatttcttataaaaaacaaaacaacaataatttatcaaaattggcatataaagactgacaacattctaataaaggcacaaatttctttttaatacttgtttcaggctctttattctctttataagttaactaatctattttcttcaaacttctgcattagttctttaaaatcacaacacttagcaagctgacttttttaatgtgctcaatacaaatacttgtgaacttttaatatgttgagtgctttcattgtgataactggatctccatttgatattttcatttatataactcatttgcagtctgaaaatttttagtgccagtccctgaatatat

SEQ ID NO: 462243 - DNA, 3224 bp, Homo sapiens
tgcagatgtggcatggccaaaaaatcccaggtttgatggaacgaaggagcggggaaaatcccttgagtgaggaagacgctagtgttctcttatatctgtagcaagtctggctgaaatgcaaatatccaataatcagagtacaggaagcacctcgcccttagagaagctgtggctagaatccgtcaagtcagtctggctctgccgggcctgatacccaaggcttccgctgtcactcagaagtgaggggcggggcctagcattccatccaatcagaggtgccggggcagggccctgcccattgtttatccaggcacagagtgggtcgcattcctgtcctcacctttgtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacctgaaaaatcttacactggagagaaaccctatgagtgtaagcaatgtggcctccagctgcccagaacagctgcagagagtgtggattctgagaagctgcagggccctggaaagcaggagacccacgtgcaggatgccctatccaatcggggtgctggggcggggccctgccaactgtttaatccgccggaaggagggcgcagcattgccggtcttctcattgcctggctgctagaggaaacccgaagtcgggattctttctttcctgctctgagagggaccaggtccctcctccgtagcttttgtctctctattgcctgcgccgtgtcctggactgctcacgggagttctgcaggagacgccggaatatctggaagctgaaaaatggaaataaatggaaagaccagaatattgaagatcactacagaaatctaaggtgactcccacgaccagtgcgggtcacagcacaggcgacagaagctatggcagaggcacctgaaccctctcggaggggaaagccaggctcccaacctcagctcgccgcctggagccgggaaccgaggagagcagggccttcgccctccccgatggacactcggcaggccccgcccagcgcccctgattggacgaagcgccgggccccgccccctcagccttttgagtcagggtctcaccctgtggcccaggctgccctccagtgatgccatcatgactcagtgcaacctcaaactcccaggttcaagcgatcttccatcctgacctccaaaagggctggattatacacataagccatgtcacactttatatgtttctagggaagcttttctaagaataaatacattggaactaggtt

SEQ ID NO: 462244 - DNA, 360 bp, Homo sapiens
ccggatccagcgatagattctttaagccagaggtggaagtggcactccttactaatttacctgaaagcactatttcctgagccatggagactgagtatagcaatgatatgtgatctaaagaagttcccactctgcttcttctctgcagtgaagtcctgccagttttgagtcagggtctcaccctgtggcccaggctgccctccagtgatgccatcatgactcagtgcaacctcaaactcccaggttcaagcgatcttccatcctgacctccaaaagggctggattatacacataagccatgtcacactttatatgtttctagggaagcttttctaagaataaatacattggaactaggtt

SEQ ID NO: 462245 - DNA, 3335 bp, Homo sapiens
tgcagatgtggcatggccaaaaaatcccaggtttgatggaacgaaggagcggggaaaatcccttgagtgaggaagacgctagtgttctcttatatctgtagcaagtctggctgaaatgcaaatatccaataatcagagtacaggaagcacctcgcccttagagaagctgtggctagaatccgtcaagtcagtctggctctgccgggcctgatacccaaggcttccgctgtcactcagaagtgaggggcggggcctagcattccatccaatcagaggtgccggggcagggccctgcccattgtttatccaggcacagagtgggtcgcattcctgtcctcacctttgtccttgcgcagccggtggttgatatccgctgtatccatccccgagagggacctggtacctctacccaggtttctatcgctctgtctcctgcgctgtgcccttctgtagtcacaggagctgtagagaggaccccaggacatctgaaagccaggaaatggaccctgtggcctgtgaggatgttgctgtgaacttcacccaggaggagtgggctttgctggatatttcgcagaggaaactctacagggaagtgatgctggaaactttcaggaacctgacctctatagggaaaaagtggaaagaccagaacattgaatatgagtaccaaaaccccaggagaaacttcaggagtctcatagaagggaatgtcaatgaaattaaagaagacagtcattgtggagaaacttttacccaggttccagatgacaggctgaacttccaggagaagaaagcttctcctgaagcaaaatcatgtgataactttgtatgtggagaagttggcataggtaactcatcttttaatatgaacatcagaggtgacattgggcacaaggcatacgagtatcaggactatgcaccaaagccatataagtgtcaacaacctaagaaagccttcagatatcacccctcctttagaacacaagaaaggaatcacaccggagagaaaccctatgcttgtaaagaatgtggaaaaacctttatttcccattcaggcattcgaagacgcatggtaatgcacagtggggatggaccttataaatattatatcttatccatgaaagaactcacactggagagaaaccgtatgaatgtaaacaatgtgttaaatcctttagttattctgctacccatcgaatacatgaaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacctgaaaaatcttacactggagagaaaccctatgagtgtaagcaatgtggcctccagctgcccagaacagctgcagagagtgtggattctgagaagctgcagggccctggaaagcaggagacccacgtgcaggatgccctatccaatcggggtgctggggcggggccctgccaactgtttaatccgccggaaggagggcgcagcattgccggtcttctcattgcctggctgctagaggaaacccgaagtcgggattctttctttcctgctctgagagggaccaggtccctcctccgtagcttttgtctctctattgcctgcgccgtgtcctggactgctcacgggagttctgcaggagacgccggaatatctggaagctgaaaaatggaaataaatggaaagaccagaatattgaagatcactacagaaatctaaggatgaaatcaacagccaatctgggtgccattgagacatctaaagccttactatgagccagatacccaggaagaggttttgggaggatcccaaagactccctggttgcagccatgtcaagactgatgctgaggaggaccccaactgtcacgagcaacaactgcctggggacagatcaagaagctgtcacagatggcagagaaaaacctgagaaaagcgggacaaccagtcacaatgagtaatttaatgatagctatgacagtggtgatcaccattgccatgagtattccttcaacaagggctgacacagagaacaattacacttattgggcatatttatcaatcttggctggcaataatgcctggatgtgatcactctatgacacagttacacatgctttctggtctcagtatttaccataataatctgctcctataattgaggcatactgccctcaaaaaactatttgtaaacaggattggacctggtcagaaaaaatgaacgtacttgtttgggaagattgcattgc

SEQ ID NO: 462246 - DNA, 5180 bp, Homo sapiens
  misc_feature (3434)..(3434): n is a, c, g, or t
ctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccnttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattggtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatcctacaggaggaggggtgtgtgtgtgtgtgttgtgccaaaggacacagcctgtgtaaaggtgtgcagagttgggagataatggctttttcagagccctggaaatggttatcatgaacgaggtatggggtgcgtggggagtgaacttgaggacaaatcataagagactttatcagccactctagggagcttggaatatatcctaagagtaaaggggagctttgcaagggatttaagtgggggaaggaggcaggc

SEQ ID NO: 462247 - DNA, 3961 bp, Homo sapiens
  misc_feature (2215)..(2215): n is a, c, g, or t
tattacttgtttaatgcctgtcgaccctcatacttgggagttcttctatggcacctacgtctcctctgggaagcacgtccagactccccccgtacaacacacagccgatgaccgaccctcaccccgctcttccccctccccaccccgccgcagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctggtaacaccctgggagactttggtggggtaggatctcagatgagccaggcaggggcaacacaggatcctgccaaaatgagacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccnttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattggtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatcctacaggaggaggggtgtgtgtgtgtgtgttgtgccaaaggacacagcctgtgtaaaggtgtgcagagttgggagataatggctttttcagagccctggaaatggttatcatgaacgaggtatggggtgcgtggggagtgaacttgaggacaaatcataagagactttatcagccactctagggagcttggaatatatcctaagagtaaaggggagctttgcaagggatttaagtgggggaaggaggcaggc

SEQ ID NO: 462248 - DNA, 3272 bp, Homo sapiens
  misc_feature (1526)..(1526): n is a, c, g, or t
ctgtaggtgctgctgagataggtcgtggtcgtaagcggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctggtaacaccctgggagactttggtggggtaggatctcagatgagccaggcaggggcaacacaggatcctgccaaaatgagacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccnttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattggtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatcctacaggaggaggggtgtgtgtgtgtgtgttgtgccaaaggacacagcctgtgtaaaggtgtgcagagttgggagataatggctttttcagagccctggaaatggttatcatgaacgaggtatggggtgcgtggggagtgaacttgaggacaaatcataagagactttatcagccactctagggagcttggaatatatcctaagagtaaaggggagctttgcaagggatttaagtgggggaaggaggcaggc

SEQ ID NO: 462249 - DNA, 4356 bp, Homo sapiens
  misc_feature (3513)..(3513): n is a, c, g, or t
ctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctggtaacaccctgggagactttggtggggtaggatctcagatgagccaggcaggggcaacacaggatcctgccaaaatgagacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccnttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattct

SEQ ID NO: 462250 - DNA, 3106 bp, Homo sapiens
  misc_feature (1360)..(1360): n is a, c, g, or t
aggtgcaagggattctgggaaagaagttcattcaatgggacttgctgtcaggaagttagacaaaatggggcctctgtaggcaaggaaggaagtctgagtgtatgccccagctgggtcgtgtgcccacaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccnttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattggtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatcctacaggaggaggggtgtgtgtgtgtgtgttgtgccaaaggacacagcctgtgtaaaggtgtgcagagttgggagataatggctttttcagagccctggaaatggttatcatgaacgaggtatggggtgcgtggggagtgaacttgaggacaaatcataagagactttatcagccactctagggagcttggaatatatcctaagagtaaaggggagctttgcaagggatttaagtgggggaaggaggcaggc

SEQ ID NO: 462251 - DNA, 1850 bp, Homo sapiens
ttgctttattgctttatttcaaccccacctaggcccacaggatgcttgtgctaactgagggcacttcatagtcctgaggaccttgggctacttcctgcctccttgatgtcctctccatcccccctcccctaagccaggctattggagatgatggtgtcaccagctgctgggactacccacagggctgggtgtgagggaggagaggtcaccagatcctcaggtgtctcaggaggctgcagcctgggccacagccctgggaatgggctcctttcagactcggcacccatggcctgccctccttctcaggaagacacagaatgggggtaggcacacaaggcctgctgcatgtgcaagggaagtggaagaatcagatccaggtgtggtccctgcagcccctcctgtgcactgtactagtcttggaggggctggtttgtcttaaaaagcacaaggcattgaggacaatcccattttcctcatgataggtctaaacggtaccacctctaggaactgtgcctgtggacagttcctcatcaggatgtctgggaacaccagcaggtgcacctgagtcactgctggtggggagtgacgctcggagagtgtggctggcctgacaccgagtcactctcggctccctttccgagctgccggacccagcacacagcagcacacggcatttcaaagaagggggccctacataactggagcttggataaacaggtctggggactcgctgcaatgggaagagatgatgggcttgggaataggggtgcatgtttccaaaaagtgagtagagatttacacagggcagtcagaatggcatttctcaaagtgtggtctgtagacttcggggaagcacccttaagaccattttaggggtgctgtggggacctcttttccaatgacatatctatgtgatgccagattttcttcatagatgtcaattaaaacaacctgtcgcaagacccagtgcaaaagcgcaaccaaaatctttctaatacaaataaacttaacttctctggccaatccagttctcagatccaaaaagccccgtaaaatcccagaaaataacaagggttggcaagaatgtgaagaaactggaaactttgtgcgctgctggtgggccctgaatccaaaacaagtgttcttacaagagacacagagaaggcagcaatgtgaaggtggaggcagagaagggagtgatgcggccacaaccaccagaagctggaagggagaaagagtgaaatctcccctggaatctctggatggacacggccctgccgacactctcatctcagacttctggcctccaaaccatgagagaatatgtttcggggcacaccaggcaaaagggagaagagatcaaggcaagtggccgggacccctcccttcttccacagctgcagacctcagccaagagcacagctgtgggcaaccaaggacgttattgccagaaatcaacttgctgtctccaccagccctgaagcctctgtgggtgatgaaggaaatgctgacactgtccacgacaaggatgaggcttgaagactccactaagagaaataagctcggaacgagaggacaaataccgcatgaggccacttacgtgagggaccaagagtatctaatcattcaaagtactcaaattcacagagacagagggtaaaatggcagttgctgggactggggaagggggaattcgtgttgggtggggacagggtttcagtttgaggaagatgaaagagttctggagatggaaggtggtaatggttgcacagcaatatgaatgtgcttaatgccactgaactgtgcacctaaaatggttaaaacggtattttatatttgtatattttatc

SEQ ID NO: 462252 - DNA, 2063 bp, Homo sapiens
  misc_feature (3)..(3): n is a, c, g, or t
  misc_feature (6)..(7): n is a, c, g, or t
acntcnnggcgttcccttgggataaagtgtggtcaaaacagctatgtttatcctgaaagcgcaaggcggaggctccaatttgggcccgggctccgccccacgggctgcactgctgccctcggagaggcaaagatagggcaggcgttattagtcccactcacaagtgggaactcttcagctgagggaggcgaagtgacagccccaatgttgcacagatggttctgaggccaaacgaggtcaggaacccagaagccaggatctagtttgacgcagacctgcgggaggcgggcggtaacggatgcgttctccctgacaccggtgccttcgcctctctgcgccctgcaggcgcccccagttccccagcctcccagacctcgcatctgccccggggctcagctcccagggacttccgggagcagctggccccgccccaaggctccttcgggctgcgcgattggcaccgcgggccggggcagggccggagcgccgagccaacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacatggatgtgggccgctgccgggcatggctgcggctggccctgaacaatggcctgatggagtgctacctgaagctgctgctgcaggagcaggcccgcttgcaactacagcggaaggaatctctggattccatttcccattcttcaggctctgaagacatcgaagtccatcactcgggccataagatacggaggaaccagaagccgactgcctcctccctcagcctggacacggccagttcatcccagctgtcctgcagcctaaactctgatagctgcttactccaagagaatggctccaagagtccagaccattgcgaggagcccatgtcctatgactcagacctgggcacagcaaatgctgaggactcagaccagtctctgcaagaaaaaacaagagctggatctcagaggatgacttctaccggccttcccgggagcaacccctgaagagtgcttcagaccacccaatagcttcttacagggggactccagagtcaaggcctggtctccacaggcatttttctcaagaaccaagaaaaaactgctccctgggggcgttagaccaagcgtgtgtaccttccccaggaagaaggcaagcccaggcagccccatcccaggggcataagagtttccaggtggtacaccggaggcagatgggtaggtgaccaggagggtcccgggtgggtcccatctgcagggaccaggcctttcagaaggcagctgtgaagttctgttttccattgctaaaggggtagtgtgttcccacaagtgttataaaacctcattccagaatgccatcataatcatgttcattcagggaagcatttcaggaaaagtagtatattgtctcaaaactgcctacagaggacaaaaatactgtttcaccagtcaaataggaaaatattttccctgaaaactatgcaatttatgattatagaaaactcttgattccacctgtagctcagagcacatccagccccatgaagccccaggtgttttaaatggtccttccaaacgtgtttaccctcagtagttggtttatgtaacagctctgggtggcttga

SEQ ID NO: 462253 - DNA, 1815 bp, Homo sapiens
  misc_feature (3)..(3): n is a, c, g, or t
  misc_feature (6)..(7): n is a, c, g, or t
acntcnnggcgttcccttgggataaagtgtggtcaaaacagctatgtttatcctgaaagcgcaaggcggaggctccaatttgggcccgggctccgccccacgggctgcactgctgccctcggagaggcaaagatagggcaggcgttattagtcccactcacaagtgggaactcttcagctgagggaggcgaagtgacagccccaatgttgcacagatggttctgaggccaaacgaggtcaggaacccagaagccaggatctagtttgacgcagacctgcgggaggcgggcggtaacggatgcgttctccctgacaccggtgccttcgcctctctgcgccctgcaggcgcccccagttccccagcctcccagacctcgcatctgccccggggctcagctcccagggacttccgggagcagctggccccgccccaaggctccttcgggctgcgcgattggcaccgcgggccggggcagggccggagcgccgagccaacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacatggatgtgggccgctgccgggcatggctgcggctggccctgaacaatggcctgatggagtgctacctgaagctgctgctgcaggagcaggcccgcttgcaactacagcggaaggaatctctggattccatttcccattcttcaggctctgaagacatcgaagtccatcactcgggccataagatacggaggaaccagaagccgactgcctcctccctcagcctggacacggccagttcatcccagctgtcctgcagcctaaactctgatagctgcttactccaagagaatggctccaagagtccagaccattgcgaggagcccatgtcctatgactcagacctgggcacagcaaatgctgaggactcagaccagtctctgcaagaaaaaacaagagctggatctcagaggatgacttctaccggccttcccgggagcaacccctgaagagtgcttcagaccacccaatagcttcttacagggggactccagagtcaaggcctggtctccacaggcatttttctcaagaaccaagaaaaaactgctccctgggggcgttagaccaagcgtgtgtaccttccccaggaagaaggcaagcccaggcagccccatcccaggggcataagagtttccaggtggtacaccggaggcagatgggtaggtgaccaggagggtcccgggtgggtcccatctgcagggaccaggcctttcagaaggcagctgtgaagttctgttttccattgctaaaggggtagtgtgttcccacaagtgttataaaacctcattccagaatgccatcataatcatgttcattcagggaagcatttcaggaaaagtagtatattgtctcaaaactgcctacagaggacaaaaatactgtttcaccagtcaaataggaaaatattttccctgaaaactatgcaatttatgattatagaaaactcttgattccacctgtagctcagagcacatccagccccatgaagccccaggtgttttaaatggtccttccaaacgtgtttaccctcagtagttggtttatgtaacagctctgggtggcttga

SEQ ID NO: 462254 - DNA, 1214 bp, Homo sapiens
  misc_feature (3)..(3): n is a, c, g, or t
  misc_feature (6)..(7): n is a, c, g, or t
acntcnnggcgttcccttgggataaagtgtggtcaaaacagctatgtttatcctgaaagcgcaaggcggaggctccaatttgggcccgggctccgccccacgggctgcactgctgccctcggagaggcaaagatagggcaggcgttattagtcccactcacaagtgggaactcttcagctgagggaggcgaagtgacagccccaatgttgcacagatggttctgaggccaaacgaggtcaggaacccagaagccaggatctagtttgacgcagacctgcgggaggcgggcggtaacggatgcgttctccctgacaccggtgccttcgcctctctgcgccctgcaggcgcccccagttccccagcctcccagacctcgcatctgccccggggctcagctcccagggacttccgggagcagctggccccgccccaaggctccttcgggctgcgcgattggcaccgcgggccggggcagggccggagcgccgagccaacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcaacacatcatctcagagttggagcacctgacgtttgtcaacatggatgtgggccgctgccgggcatggctgcggctggccctgaacaatggcctgatggagtgctacctgaagctgctgctgcaggagcaggcccgcttgcaactacagcggaaggaatctctggattccatttcccattcttcaggctctgaagacatcgaagtccatcactcgggccataagatacggaggaaccagaagccgactgcctcctccctcagcctggacacggccagttcatcccagctgtcctgcagcctaaactctgatagctgcttactccaagagaatggctccaagagtccagaccattgcgaggagcccatgtcctatgactcagacctgggcacagcaaatgctgaggactcagaccagtctctgcaagagagccgcatccccaggcgcccagccccctg

SEQ ID NO: 462255 - DNA, 1012 bp, Homo sapiens
caagggctgtgacagatgagcagtggtctgtctgcaatgagcatgtgctcaagctaacatggataccatcttggtcttcagcctaatcattgcatcctatgatgccaacaagaaagacctcagagatagcagttgccgactggaacagctgcctgggatcttcccaaaagacgtgagaagcatcagagaattgcaaatgcaagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaagcttttttaccagggatctcacaatgtaaagtcctgggggcttcatcagagacttttcccaccagtgccccttctataactcctgggaataaagaaggagagaaaactacaagtaccgacacagatgagaacctagagaagagacagaaatggagtattgtggtcaaaattctgattgctgtcaccctgttgctcagtggagttgccattatagtatttgtaatttttgaagtcccatgtccttatcaatgcctaggagccaggaagctgtgccaatgccagtggttgtggagatggcaaaagaagggaggccagccacctgggacagctgaatccaagcctgactctcagccccagaaggaaagtgttctctgtgtggtttatgtcatttgcttaaagaagtgtaattatcgattaacaaagaggcaaaatgaagtgcacttggaattacatggggttttgtacttagccagcccttttcttggtacatgaagaactatacacttgcatccttttttaactttcatatttcctttcaatctctaggttggacaagatgctgcc

SEQ ID NO: 462256 - DNA, 2692 bp, Homo sapiens
gtcctggtagagggcccttcacgtgcacacagctgcatggacgaatggcagccgagttccatccggagagcaggcatagaaacacggggatagttgcagcagctctggcatctgcacccaccctcacctacagcttaggggaaaatgagagcttctcacccagcattcccacaacctgtttgcatggtgagggagaaaaggctgatgaattactaatgaattgtgggggtgattttgatggcactttcttcagcaccaaaagtcagcaaagacttggagtgggacagaaatatagtgaatgctcttttgataagagctttatcgggtacgccttcacctgggaagacggcagtctcagagagagaccttgtggacacagcttctccattgggcccctggtggccgaaggggaccttcattctggcactttcctctacagacacagagcagatgggccccgtccttctcccacttttagtctaaggaccatcaatcaataattcctccaatcaaaaaataaccactcaatattttgttgaatcatctttcagacttaagtatataaatatagatacatatttcataaatgatccacatttatgtaaatattattttactgtgtatagtatattcaatcatttgattttaaaaaatgacctcatttgtatctagctcttcaaggcagaggtcatataatttcagagccactattccttctgtaatcgtcccaggaaaaaatcttgtctccctgacttgaagtcctacatacccactgccccatcacctttgaacgacaagacatcttaatgtccacaattacaactatgagtttgttccagtaaaaaataaaatgggaaaagggaattatgggtgcacataattaagaaaatagggtgattaatatcttttgagaaatttataaataattgatatctagtctggggaaaatctgctcctacaactttctttttccggagagttggctaacagttcacatactttaaggggtgccgcaaaaatctaacttaacgtctgttgatttttattagtctttggtctaagcacttcgccaatgaaggcattcaaaagtctatagctacctttcaaagaccttacttggcaaagctgtagaccaacagtcctcctgaatctttaatccacaatagattttcagactaatattcgaactcgagtacagagacatttcccaccgtccatccaaacaaaatgaagtcagtttgactgtgcaaaatgtcgatgaattcttcagagtaaatcagccttgtcagggtgatgcagaaccatcagctctttgtgacataatataatatgaaatgatattgaacaacatgcgtttggcactaaattgttagcgggttttagctttgacagcagcaagtttattgctttaatcccaaggtcttttaaccctctttgacataaattgaggttggcttttgtgaaaaaatctccactttactctctcttcctttacctaaaactgcttttaacaatttatgctagtacatcagacactcattttgagtgacaaaaagaaaaaaaaaaagaacaaggtctattagaatagaagggaagaaaaggccaacttaggctaagaaggggaaaaaaaggccaacttaggctaggcagtctgtgtctctttcggtagatacgtcacagctttcttgaggtggatatgcattttaagttataataacatgtggctctggctctcacaaataaaacaagcctggacagaagactccggcaaggtggaggacagccattgccagggaacaaaggctcctaatccgaaacagaggccgtttttgcattttgctccagttgaatgtatttccttatatgggttcatgccttcctcctccaccacctacccccctacatttttagagatcaaagatgacttttcttttatagaaatagttttgaaacactgatttacccaagaaaaccatgcaaaattccccttgtgctctttgaaagcctggaagatgctactcaagggtgagaattgtgggcctattacatttaaaatagatgttccttccactcaatgcttgtgagtgggtttgcatttgggttgctttccaagtttttgcatgaatctcctaaatttttacgaaggtgtatatttgaagaagccagggatttcagcccccatccaaactggtgattggctcctaaacttgtttcctgaatcatgccattctggtgtcagagcccccgcgatgccggcagaagccgtgggcctccaccttacagacccaccgtgccgcctccttcccggccgtcacacaggtgggagagcagtgctgacctcctaagcaggagtcagtgctcaaggataatgtctaatcacttagctatgggcaccaagcttgctcctctcaggcccacttccaacccccaggcctgggagtcatgagcagaactgccctaaattatactgcagatcactctagagttccactgtgttcagacaggtcttattctgaattgatgaccagcccctggctcccagctcaatccataggatccactcaaacccaccctctgcaggcactacatttttaccaaatgtgtttttccttccagttcctgtattccagatagcccagagacacaggtaaaccccgtggactccccgtccctaacagcatcgtgagagctg

SEQ ID NO: 462257 - DNA, 2181 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccacccaggcctaggcctgggcctgggctgggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtctttatggttttatatataatatattaaaaaatcaaaagtctgtatgaaaatatcagattgcacccccctctccccattcctggcttttgccccctttttcttgttaaaaaacaaaaaccaaaaaacaaaaaaccacacacacattttgtacggggtggggaggggaatggggagggggtttggcaatctcactaaccaccattaaactgaggagagaccaagtgtttgggg

SEQ ID NO: 462258 - DNA, 1726 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccacccaggcctaggcctgggcctgggctgggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggggaaaggagtttggggaggattcgtggtctttatggttttatatataatatattaaaaaatcaaaagtctgtatgaaaatatcagattgcacccccctctccccattcctggcttttgccccctttttcttgttaaaaaacaaaaaccaaaaaacaaaaaaccacacacacattttgtacggggtggggaggggaatggggagggggtttggcaatctcactaaccaccattaaactgaggagagaccaagtgtttgggg

SEQ ID NO: 462259 - DNA, 2020 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccacccaggcctaggcctgggcctgggctgggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggggaaaggagtttggggaggattcgtggtctttatggttttatatataatatattaaaaaatcaaaagtctgtatgaaaatatcagattgcacccccctctccccattcctggcttttgccccctttttcttgttaaaaaacaaaaaccaaaaaacaaaaaaccacacacacattttgtacggggtggggaggggaatggggagggggtttggcaatctcactaaccaccattaaactgaggagagaccaagtgtttgggg

SEQ ID NO: 462260 - DNA, 1217 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacggtgagagcaggctgcggccgactgagggcgggggcggggcgccaggtggcgggggcggggcttgagcaaagaggccacataactcaggggttcggcagccaacagagttctttttgttttgggaccagactggcccgcggggctcaaattcgggttggctgcattctattgcaggtaaccgaacctgtctgcgcctcagtttacccatcagtaaagtggaaataaacaatagcacctatataaca

SEQ ID NO: 462261 - DNA, 1932 bp, Homo sapiens
ctgccacctgggaccctggttccctatggtcgctgggaacaggcagctcgatcgctttgagcccacgttcgtgccttctttaaccccttacttcccttctccctgcggcagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggacgacggtggtatcatcatctgtgaggcgcagaaccaggcgctgccctccggacacagcaagcagacgcagtacgtgctggatgtgcagtgtaagtgaccggcgggccaggacccaagggatcccaacgccagccacccgcacccgcgagggtcccccttgtcctgcgtgatggcttggaaactactctctcctcttacttttgcctaacagactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccacccaggcctaggcctgggcctgggctgggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtctttatggttttatatataatatattaaaaaatcaaaagtctgtatgaaaatatcagattgcacccccctctccccattcctggcttttgccccctttttcttgttaaaaaacaaaaaccaaaaaacaaaaaaccacacacacattttgtacggggtggggaggggaatggggagggggtttggcaatctcactaaccaccattaaactgaggagagaccaagtgtttgggg

SEQ ID NO: 462262 - DNA, 378 bp, Homo sapiens
catggatttgaataaaacaatttattttcctaattgctgaattcgctgggagcagggcaaggaaatacctccaagagaaaggataagggtggcactttcggtgagcttttggagtcttcctaattctgcttttacctctttctctgccactgtttacctctttctctgcctctccctgtgtgttccgtttctccctcttccttcgcctggcatgtgtcttgtctgtctccctcttcccttatacttctgtccaactcctggatccacaaatatgtcccccctgccccgggggtctgtcaccccctcaggttcctatctgacccacgaagccagtggcttggatgaacagggagaagcaagagaagccttcctcaatgg

SEQ ID NO: 462263 - DNA, 1835 bp, Homo sapiens
ctggcatcattcccattttatagatggggcaactgaggctccgaaaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaaggggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtctttatggttttatatataatatattaaaaaatcaaaagtctgtatgaaaatatcagattgcacccccctctccccattcctggcttttgccccctttttcttgttaaaaaacaaaaaccaaaaaacaaaaaaccacacacacattttgtacggggtggggaggggaatggggagggggtttggcaatctcactaaccaccattaaactgaggagagaccaagtgtttgggg

SEQ ID NO: 462264 - DNA, 1165 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacggtgagagcaggctgcggccgactgagggcgggggcggggcgccaggtggcgggggcggggcttgagcaaagaggccacataactcaggggctcaaattcgggttggctgcattctattgcaggtaaccgaacctgtctgcgcctcagtttacccatcagtaaagtggaaataaacaatagcacctatataaca

SEQ ID NO: 462265 - DNA, 1043 bp, Homo sapiens
gtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacggtaaccgaacctgtctgcgcctcagtttacccatcagtaaagtggaaataaacaatagcacctatataaca

SEQ ID NO: 462266 - DNA, 1371 bp, Homo sapiens
gctctggcttctgaactggcagggatggaactaggttccacatcgggggacctgcgctactcagtatgtctttgcaagactccactctttccagagaggggaaaccagagggagagattatggctgctgtgtttttctcagttggacgcctgagccctgaagttacccagccagatgaagatcttcaccttcaggcagaagaaacacaattggtaaaggaatcggtgacatttaaggatgtggctatagacttcacattggaggagtggaggttgatggaccctacacagaggaacctgcacaaggatgtgatgctagagaattacaggaatctggtctccctggggcttgcagtttccaaaccagacatgatatctcatttggagaatgggaaaggaccatgggtgacggtgagagaaatttcaagaattccctatcctgggtctcattctatcacccaggctggaatgcagtggtgtgatcatagctcactgcagtctcaaactcctgggctcaagtgatcctcctgcctcatcctcctacatagctgggagtagaggcacacaccaccacacctaagatttttattttttgtagaggaaggggtctcactatgttgaccaagctgttctcgaactcctgggctcaagctatcctcccacctcgtcctcccaaattgctgggatttcaggtgtgagtcaccatgcctgacattacttggcttttaaaaacattactgtttttagtcctttttcttgtatgtttgagttttattactttctgttctttattattttattccattcttagagcttaatttgtggatcttttctaacctcttgaattaggtacttagatcgttgattttcagctgttcttcttttctaattgtttagggctatcagaactatatcacacttttttatgtagcatcttcataatttttgagtggaaaatattttataatttctattgtgatatcttttatccttgggttatttttaaatgtttttcttaattttgtgccatttgggaattttctagcaatcttgttgactttaattctactatggtcagacaggatgctctgaattatgtcagtctttgcagaattttgtaaacattttgtgctcttgaaaaaatgtacagcctataggtattgagtattgagtacaatttctagatgtgtcaggagattaagtttgttaattatgttaaaatctgtatacttacagcttattctatcaattgagaaagattttttaaagtctgctagtgagactatacatttgcttcctatttagttcatttaatttttttctttctgtatttgaagctgtgttattatgtaaatacaaagttataattgtt

SEQ ID NO: 462267 - DNA, 1248 bp, Homo sapiens
  misc_feature (986)..(987): n is a, c, g, or t
  misc_feature (990)..(991): n is a, c, g, or t
  misc_feature (997)..(997): n is a, c, g, or t
  misc_feature (1000)..(1001): n is a, c, g, or t
taagttctgattcagtgatcaattaaatgggtggcagaagttactggaaagagacctctcttcccctggatggcatcgtgtgaagacatgtgacttgcagtcactgtggacatttgtgaccacaaagacccatgaaactggatgatgaagccaaatctaataccacagaaggcagagcaaggagagggggagaggctggccttggtgacattgtttgaatctagtcttctctgaatcagtcccaccttagcccttctcaatcatgattatggcatccagctgcatccatgtcactgcaaaggatatgatttcatcggaaagaaagtatttgaaagagctttgttcaggtcatgctaactatcatgtcatgaggacactcacgcagcctatggagaggtccacatggtgaggaactgagacctctggccaacagctttgtaagtccatcatctcaaatctccaaccccaatctagccttcagatgactgtagcccaaccaacatcgtgactgcaatctcatgagagaccactcattgcaaacctgatcctggattcctgaccctcagatactatgagataataaatgtttttagctgctaagtttgggggtaatttgttatgcagcaatagataattaatatgggaactgcttaatgttgttgtaatggagatgctggctaggtgtttctaaaatgtttacatgggagatggattgggagggtgcaattggctccctgcaaatccatcactactggaaaacaatttatacacgtttttaccaagggtggatcaatattactcggggtgcctttaggttagcgctttacatgggatcatctgaagtcacaagtaattctcgaggggcgctgttgatacaaattccatcagtactacatggactccattgcactaaccacggatgcgccctgttcacagctttacccggacatttagccctggttcttaacactgaagagttaacaggnntgnnggaganganngttttagggcaaaggagagaaatgataaagggaagggaaaaagagatcaggtggccagagcagctcagcatcttccaattccttgcaaaggcaatttgttctccattgttgctgagaccaagggcagaatgtccaggaccttgggctgacacagaatttgctagggaaacttgggttcaccaaaaaagaacagaaattttactgccacctgcacctcaccttccaggggaagttttgttatgtggaa

SEQ ID NO: 462268 - DNA, 982 bp, Homo sapiens
attaaggagtttggggaagtcgcagagctgcagcggaaaggcaggggtctgagactacttttgagaagagaaacaacgcaaaacgatcgctggagggccagagcctgggtcgaaggtgccctagcttttatgacctggttaattgtgtctcctttttatttttatttttttccttaccactactactactactacttttatttttttttaaccgatacactttggagagaagaagcagacacaggttcccacggcgtctgacgctgcggagcaagtccagagccagctggactcgcagcctctggcccggcggcaccaactcctcactgggtcattttgagcgcgctgtgcccaccttttctgttgcgtgtggacgtggggaggatcttctaagtccctccaacgaaggcaagtgtgagactctggccctttatttgtaagaagcaagccttcagattgcagaagtgtcgcgcgggtcgccgtgcgttgcgcgagtgggaagatggaggaggccggcacgctgctttcgtggacgcaagtgaaccgggcgtgaaggcagggtgcgagctctgcccttggcccagccctgcgtgggcgccgtcccagattccgggcggtgcggggtgcagagatctggagagacttgcgggctccccagcgcaggctgctctgggatttcgttggaagatccggcagagccttggaggagagggcccgggaggctgtgtgtgcagcggaaacttgtacgaatgcccccacagcggaaatggtgcgcacgagtaatttctgcggtgcacccttttaaaaattgacaagtgaacaagatcaattttttaagaaagcaaaggtagaaaacaaaaggcgtgcgacttcttgactggcttgttcccgcctttcttccttctctatactcagatcagaaacttttctttaattgctcttattcagtgcgacaacttttaataaaagcatttgcatttta

SEQ ID NO: 462269 - DNA, 503 bp, Homo sapiens
ccgagcggccgccaggatgtgcccccggccccgtcgtcgccgcgcccgcgcccctcgccccagtacgtcttttttcgtttcctaaatttcttatttttgtccttgcaagtggtcctgtctggtgtgaaccgtcagcacagatggcctcctggagcttccccgagtcgttcgctgggggaagcgggcggtgagcggccagcccgggcgctccgcaggccgcgagctcccggcagggctggtggcgggggtccgcctgggggaggaatccccgcctgctccatcggacccggcctggcgcggctcgcggcgctcggcgggctcccttccattctagaatcttcccgcttgcttcccagcccgcgttcttccgcctgcctttaattgtgtaagtttgacgaagtcagagctttgggttccaggaaaagcgcaggagggtcatagaggaagggagggcgcaggttggagtcaggtccaaacagtccctatcgccacttttgaaaaaa

SEQ ID NO: 462270 - DNA, 677 bp, Homo sapiens
ccgagcggccgccaggatgtgcccccggccccgtcgtcgccgcgcccgcgcccctcgccccagtgtggacgtggggaggatcttctaagtccctccaacgaaggcaagtgtgagactctggccctttatttgtaagaagcaagccttcagattgcagaagtgtcgcgcgggtcgccgtgcgttgcgcgagtgggaagatggaggaggccggcacgctgctttcgtggacgcaagtgaaccgggcgtgaaggcagggtgcgagctctgcccttggcccagccctgcgtgggcgccgtcccagattccgggcggtgcggggtgcagagatctggagagacttgcgggctccccagcgcaggctgctctgggatttcgttggaagatccggcagagccttggaggagagggcccgggaggctgtgtgtgcagcggaaacttgtacgaatgcccccacagcggaaatggtgcgcacgagtaatttctgcggtgcacccttttaaaaattgacaagtgaacaagatcaattttttaagaaagcaaaggtagaaaacaaaaggcgtgcgacttcttgactggcttgttcccgcctttcttccttctctatactcagatcagaaacttttctttaattgctcttattcagtgcgacaacttttaataaaagcatttgcatttta

SEQ ID NO: 462271 - DNA, 4209 bp, Homo sapiens
ccgagcggccgccaggatgtgcccccggccccgtcgtcgccgcgcccgcgcccctcgccccagtacgtcttttttcgtttcctaaatttcttatttttgtccttgcaagtggtcctgtctggtgtgaaccgtcagcacagatggcctcctggagcttccccgagtcgttcgctgggggaagcgggcggtgagcggccagcccgggcgctccgcaggccgcgagctcccggcagggctggtggcgggggtccgcctgggggaggaatccccgcctgctccatcggacccggcctggcgcggctcgcggcgctcggcgggctcccttccattctagaatcttcccgcttgcttcccagcccgcgttcttccgcctgcctttaattgtgtgtggacgtggggaggatcttctaagtccctccaacgaaggcaagtgtgagactctggccctttatttgtaagaagcaagccttcagattgcagaagtgtcgcgcgggtcgccgtgcgttgcgcgagtgggaagatggaggaggccggcacgctgctttcgtggacgcaagtgaaccgggcgtgaaggcagggtgcgagctctgcccttggcccagccctgcgtgggcgccgtcccagattccgggcggtgcggggtgcagagatctggagagacttgcgggctccccagcgcaggctgctctgggatttcgttggaagatccggcagagccttggaggagagggcccgggaggctgtgtgtgcagcggaaacttgtacgaatgcccccacagcggaaatggtgcgcacgagtaatttctgcggtgcacccttttaaaaattgacaagtgaacaagatcaattttttaagaaagcaaaggtagaaaacaaaaggcgtgcgacttcttgactggcttgttcccgcctttcttccttctctatactcagatcagaaacttttctttaattgctcttattcagtgcgacaacttttaataaaagcatttgcattttaagcctgagttgcaaccatagatttattgcgaagtgacaacgtgtctatggaatattttcgcagatgagacaggacatgcgctctagtcgtgcccagattaaagcgacgctgggccatgtgcctgtgtagtgcagactcggaggggcacacacatactcgtcaccacatgaccactgtctattaatattgtcatacctaaacactcgcaaaaacaaaagttgcttttcttccctgtaattaaatctaatttgttaattgtctttcctcttgcaatgttgttttcatcttgaggtgacacattattattttgtctaatattatttacaaattaatgctgtatattttacattagtgaaacatataattaggtgtttggttcaatcggtatcattcagataaaacaaagcctatctgcaagattgattggaagtggagtagttggttctaatttaccatcacagtcacagtttattgaagctacctggccccagattcacagaagctagttttacctaaggtgcatttgatgctttgtttacaagtgtttattttccccaaccacttaatgcaaaaaaaaaaaaacaccttcaaatattagggctttcatttcattttctgtcttctttcattcctccccccacccaaagttcctttcttctattctctggccacctctctccgtttcctcccctacccccaacttttgttttaggttcttagagttaaattcagcatgatttggtgcctctaatgctgtgacaagtgactgctaattggttctcacttgagcaaagatattaccatactaatattattattgcgctcggtctccggacccaccccgggaggcccaggggttgggggagaaacaaaaagggctccacgcactgtctcccgttagagacagagtgagcccacagcctcctgctcgttggaagtgccacgcgtcctcggcgctcaagctggccctgcgctcccgggagcgccggcggagaggggcgcacgccgggtgggctcgccggcgtggaggggccgggctggcccggaggcgcacatcaaaggccgcccgtgcaatgcatgcgcgtttccctcaattaacggcatttcctgccccctcgcttcccttcatccgccccgccccccccgcgccagtccgggctgcttgagcgcggggacgagccttttcccgcgcgcccgtccgtgcgagtgcgcgcgtgcgcgtgcgcgtgcgaagggtcccaggggcgctccggatttgcccaggggaggctgcgagggtcgccgggccccgaggccccgtcgaggccgagtttcgggcgcgttttggggagagcgaggcttaagggtgcggcgggtggaacgcagggaggaccccagtttctgtctcctcgaacgttccctgtgtccgcacccacaggcttcgactctggccttaaggcgcggctgcctgcgggaccccacgtgcagggaggggcgcccgggcaccctcattccacacgccccggcgcgggctgttcccaccgcatatccgcgacctcagacgtcgcgcgccaaatgggggcggggaggtgactgtggaaagaatgtggccacaggcgcggggacggcagcacggggaccccgccccccaagtttcctcattagcgaggccgcgagggttgggggcggacgggggaccccctggctccgggctccactccgacggcaggacgggtcctcgctccccccgctcccgtcggtcccgtcccagggcggtgccagggctctgagcgggtcccagcggggctcgggcaccctcgggtgggcggcgtcaggcccgaggcccgtgtcccgctggctcccggcggtgggctgtgtccccgcggcgccctctcgggaggaggactggcccccgcccccgcccaggtctctaacccctcggaggtcaccgggtctggccccgcctcaccacgcgggggccacttggatggccgcagccagaggacgggcctgggcgaaaccccacagctgatttcagaaccgcgtctctcgccaaaggcgtcccgcgggggctgagcggggcgcagacccgaggcctcctggacggcccagcccctcgcaggtccccgcggtcctctctcggcctgcggggcggggactgtggaaggggagcgcgcgcggggagctcctggcgtgagaaatgccgcgtccatgtctccgctcgcggcccctctgcgtccgagacaaacccgcgtggggagccccgtgctctggccgtgtgcgcgcccgacgcggggacgccccctgcgcacttttcctggccgtagagctccccggccctgcacaacgagttcaaagaagtttcagaaagcggcacaacttcgatgctaccgtttccatcgttcttggctttctcatgatcacaaatgtcatttgtcttggctccaagctctgcaaaagtgcagggctgaattccgcaggaggctgcgtttgtggggaggcgctcaccacaaggtccttgaccgctgagcaggggacaaagagggccgagtgtgggggcgggggtggctcccgctcgcgttccgggatgggcgtcttctctgtgaccgattgcactgagctgttggcccacagatcccattcgggctgtcctggcaggacactgatgtatgctgtgggctggtgcagcccagggcacagcagtcagttccatggagtcgtggacaagtgtggggagagggggccgttctcaggaaatgcttcaaccagtggcaccgtcacggctgagcagttctgccgcccgggccacaggctggccattgggttgacgccaggtagaggagggccgtggataacgagaagactgggaagcaggctcaggagggtgtgggagggcaccctgacttgtttccagagagatctggtgctggtgggttcagcagccaagagagacagggttgaaaacaagattcagggtgttggtaccccgtctcggggcgccagcccagcccagcccatttctctaagttgccatggggtggagtgaatgtgctgtcatctcttccattccttgagtattttatatctttcctctgtttgttaataaggttcttctattccttgagtcatgtattttatatctttcctctgtttgttaataaggttcttccattccttgaattatgtattttatatctttcctctgtctgttaataaggttctttgaaaag

SEQ ID NO: 462272 - DNA, 1000 bp, Homo sapiens
ccgagcggccgccaggatgtgcccccggccccgtcgtcgccgcgcccgcgcccctcgccccagtacgtcttttttcgtttcctaaatttcttatttttgtccttgcaagtggtcctgtctggtgtgaaccgtcagcacagatggcctcctggagcttccccgagtcgttcgctgggggaagcgggcggtgagcggccagcccgggcgctccgcaggccgcgagctcccggcagggctggtggcgggggtccgcctgggggaggaatccccgcctgctccatcggacccggcctggcgcggctcgcggcgctcggcgggctcccttccattctagaatcttcccgcttgcttcccagcccgcgttcttccgcctgcctttaattgtgtgtggacgtggggaggatcttctaagtccctccaacgaaggcaagtgtgagactctggccctttatttgtaagaagcaagccttcagattgcagaagtgtcgcgcgggtcgccgtgcgttgcgcgagtgggaagatggaggaggccggcacgctgctttcgtggacgcaagtgaaccgggcgtgaaggcagggtgcgagctctgcccttggcccagccctgcgtgggcgccgtcccagattccgggcggtgcggggtgcagagatctggagagacttgcgggctccccagcgcaggctgctctgggatttcgttggaagatccggcagagccttggaggagagggcccgggaggctgtgtgtgcagcggaaacttgtacgaatgcccccacagcggaaatggtgcgcacgagtaatttctgcggtgcacccttttaaaaattgacaagtgaacaagatcaattttttaagaaagcaaaggtagaaaacaaaaggcgtgcgacttcttgactggcttgttcccgcctttcttccttctctatactcagatcagaaacttttctttaattgctcttattcagtgcgacaacttttaataaaagcatttgcatttta

SEQ ID NO: 462273 - DNA, 1913 bp, Homo sapiens
gaagccgccgcgtacagtgtgacctttagacaattctgtctcacaggatggacgtggtagaggtcgcgggtagttggtgggcacaagagcgagaggacatcattatgaaatacgaaaaggcccttgcaaccctttaccttggacccctcaccaaggctccctctgggctacagggacaccaagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagaggggccttggttccgccattatgatttcagacagagctgctgggtccgtgccatatcccaggaggaccagctggccccctgctggcaggctgaacaccctgcggagcgggtgtgagatcggctttcgctgcacccagcactgattccgaccagggcacccccttcagagctagggacgaacagcatgaaagagttcaatgaggaaggagaggaagtggagcatatgcttagtttccaagctggaaaagtggcccatggttaaccaagactagatgtaaaagcacaggtggccgcgggtccagacttgctttcactgtactgtaaaaaaaaaaaaaggcacaatgtagaaaggaaactctcttcaatgaatggtgttggggaaagtgcatgaaaaagaatgaaattgcacacttgtttt

SEQ ID NO: 462274 - DNA, 852 bp, Homo sapiens
aattaaaaactgtacgttttgatggcagatttctggatgacagcattgcaaaaagtaaatgatccaaatgtgcacactttccagcagaattccagatttggaacttgatccaaaggaaataaatagagaaatttcaaggccatctcatcagaagcacaattattactaaagtctcctaatgagcatctgggagcaacttgatacatgctttctgcttgttcaagcaagagggagattcttgaacattgggaggcgttgagcctgggatgagatttgggctggaagactctgagtacaatgccctggaaaggagatggaacccatgtgaggctcaggacaatctacctgtctggctggttcttatcccctctgagtatcagaggagcagacgcctgcaaatgttgtcctctgggatccagacaaaagacctaatattggctgaagctgccaccgctgcttctgctggagggactcctttgggatccctgagtgatcttgtctctagcacctggtcaaagtacgctgaggggacacagaagagccgccaattccccagagccacccatgactgtcagccctccaggccagccgtgctcacggtgcatggccctggaccctgggagagcctgatgtgggtgtcccatgagtcagcatggacccagtcccgtcactggagaaacagatccgacagccatgactcaggaatgcggatgttctgtcccaggagcaccgcagagaaaatcatgttgaaaccttgatgttattgacagaaaagaacacattgctcaatggagtgtgagtcaaataactatgaacttaaaaatatagtagtccttccttatgaaagctttc

SEQ ID NO: 462275 - DNA, 2109 bp, Homo sapiens
tgctgtcggagtcacaggatggcggctgtcgtcctgcccccaactgccggggcccagaggtcctccgtgtctgatcgggcggctcttgggacttgggacttaggcatttgggtgtctgtggatgtcacctgtgtggtgaatgtgctggagcttttgaattctcccttcagttctttctgtgaacctgataaaaacacacgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgtttccaagggacctgcgcttccaaatcacgtaggcctctcaacagggctgagtttctttatggaagcaacttctccccaaagccagtgatctaaaggagccaacacagaaagcataatgtcttttatgacctagcttcagtgagatatgttttcatgtccctgttacattggtcatacacaccaatcctgatacaatgtggaagaacaccacaggaggtatgaacagtagacatttggaaccatctggaaaacttgccatgaaatcagtggaggaaagccttcagctgaccctcatttttttttttttaagacaatgtctcactcttgcactccagcctgggcgacagagactccatctcaa

SEQ ID NO: 462276 - DNA, 1291 bp, Homo sapiens
acctggatacttcaggtgcctgtgcaggatttgcatgctgttatggttcttttcgatgagatcctccaatcacgctgcttccacccccagtggcaacggcctttgggtcccttctcgtcgtatgggagctctgttttcactcaattaaatcttgcaactgcacactcttctagtccgtgtttgaaccggctggagctgagctttcactcgctgcccaccactgctgatcgctgccatcgcagacccgtgctgacttccacccctcagggttcggtagggtgtccgctggcttctgatccagccaggcgctgcccattgctgctcccaattgggctagaggctcgccattgttcctgggtggctaagtgcctggaacttcaggattctccattgttctggcattgctgcccaccagcagaggatcaggctgacatcttcaggaggcatatggaggtaatggttaactttgctacagtgaagaccaaggtaaattgggtgcactgaagagaaaaacctgaccacttctgcagctgtgcatctggagtctgagttgtactgcgacattagctcttttgactagatgtgatgacagactgtctttggtccattctcttttattgccttggaagagaataaatgaggagtagttctcacccattgcagctgaggcatcacacctgtaatgggattaacaagatgataatatatcttttgccaagaccacatactagcagctattactaacaaagaaaagactgcttctgtaatacaacaataaatttattgaactaaaagttgagactgacatctgggcacattgggctcctcatgcctctgaataaacagacaaacaaatgagttactataccagcagaggggtacaagcaattttccagtcttgaccctttatctgttgaccaagctaaggcagaaaccagctaaattctggatttaatcttgagcagcaaaaaagatcagcttttgaagtggatctgcttttattcttggcaaaagttcagcggagaccaaccagagtggtgaccaaagttcttcaacatcaagccacatgtactacaaggaattacggatagtgcttaatctaaaattaagaaatgtccacattctcccctaaaaagttattggattcaagaatgaaaacaagagaagcatatttgtctcaaatccaaactacagacaccagaaagacaaaccaggagtttccgcgaaagttggttgccggataatcctctgcacacatggtgtttgtggcctaatcatggccacaggttac

SEQ ID NO: 462277 - DNA, 2045 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462278 - DNA, 2203 bp, Homo sapiens
tgccccgcgcccacagaccgaccgctcgggagctcgcccccgcctagcctcggctgagatgcagggctctgagctccaggtcacaatgcacgacacccggggccgcagtcccccataccagctggactcccaggggcgcctggtgctggctgaggccaggtggcgacgagcgagactacgtgtgcgtggtgagggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462279 - DNA, 2338 bp, Homo sapiens
gagatcgagccaatgctctccagccaggcgacagagcaagactctatctcaaaaaaaaagaggaaagaaaatgagagacaatcgggagagggagagaccaagaggagaagggatgggaccggaatgagatggagaaaaggagacaggaaaaatcaagaactgatagggaatgggggcaggagaaggtggggagggacagagggggaagactcctgtgtcctaggaaggagagagctgggggacccagaatccttggtccctggaggatggtgctggaggcctggactctttagtctgagtcggggactaggaatttggactcctgggtcctgggagagtcgggagttaggagcccggctcatgagtctgagtggggagaactcctgagagaggagccccgacttcagagtcccagctccaagcccaggccatgcccgtgtctgcctcagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462280 - DNA, 1995 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattccccccccccatcatctgtggacactggagtctggaataaatgctgtttgtcacatcaacaaaaaaaaaa

SEQ ID NO: 462281 - DNA, 2041 bp, Homo sapiens
  misc_feature (2033)..(2033): n is a, c, g, or t
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattccccccccctcagttcacagtggagactatggagattcagggcaggatccctcaggtacaagaaacaccttccgaagattttgctctccttccttccctccctcttgncaactccc

SEQ ID NO: 462282 - DNA, 1701 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462283 - DNA, 1729 bp, Homo sapiens
actgccaaagcgtagtacccgatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462284 - DNA, 1327 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccacagagagagcgtcgacgctctctctgtggggtatctcactgcccagg

SEQ ID NO: 462285 - DNA, 1417 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggttcagggggcagggagggggtgggcttggatggggacagtgtggggtgtgggacctggacaaacaggacgagttcctgagtccctggctggggactccatcttctgctcgatgcctctcttctctctctctctcctctcccttcactttcttcccatccccaccacccacaggctcgccagagctaaagacagcggaaatagagcccaaggcagatggcagctggagggaaggagacgaagtcacactcatctgctctgcccgcggccatccagaccccaaactcagctggagccaattggggggcagcgtaagggaccttcctctccaccctgagccccctctcactcatccaagtatcacacccccatcatctgtggacactggagtctggaataaatgctgtttgtcacatcaacaaaaaaaaaa

SEQ ID NO: 462286 - DNA, 1451 bp, Homo sapiens
acttaggctaggtacgaggctggtgtgaatcggcagagggtggagggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462287 - DNA, 1543 bp, Homo sapiens
gccctgaaaggggaaagactgtgcaagctgccggtctagcttcggaaacgatacgtattgtacgatagttacgaacgatacgtactgtcgtttccttcctacctcgtcctcaccccaccccgagtgaaacttttcgagtgtgaaccttacttttttcccgttctcctcaaggcagtttgaacgacacaggtttggaaggaatagttaactctccagtattactggaacatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462288 - DNA, 709 bp, Homo sapiens
  misc_feature (37)..(38): n is a, c, g, or t
  misc_feature (51)..(51): n is a, c, g, or t
ctctcgctccttgtggtcattttttatagctgaaacnnaggggggcccttnttccacccaccgcgggaaaagggggctcgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462289 - DNA, 782 bp, Homo sapiens
gagatcgagccaatgctctccagccaggcgacagagcaagactctatctcaaaaaaaaagaggaaagaaaatgagagacaatcgggagagggagagaccaagaggagaagggatgggaccggaatgagatggagaaaaggagacaggaaaaatcaagaactgatagggaatgggggcaggagaaggtggggagggacagagggggaagactcctgtgtcctaggaaggagagagctgggggacccagaatccttggtccctggaggatggtgctggaggcctggactctttagtctgagtcggggactaggaatttggactcctgggtcctgggagagtcgggagttaggagcccggctcatgagtctgagtggggagaactcctgagagaggagccccgacttcagagtcccagctccaagcccaggccatgcccgtgtctgcctcagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgtgagtctgtgctggcctttgacctctgacctcaggctccacacctcatgagg

SEQ ID NO: 462290 - DNA, 1686 bp, Homo sapiens
accgcccctggagagcccctaattgagtgggtggcggtctgggacgagtgacagactgtcccccactgcagatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgcc

SEQ ID NO: 462291 - DNA, 2007 bp, Homo sapiens
tggtgtggtaggggcggagcgatgtgagcactggcggtcacgtgttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462292 - DNA, 1939 bp, Homo sapiens
  misc_feature (7)..(7): n is a, c, g, or t
  misc_feature (10)..(12): n is a, c, g, or t
  misc_feature (16)..(16): n is a, c, g, or t
  misc_feature (18)..(18): n is a, c, g, or t
  misc_feature (21)..(21): n is a, c, g, or t
cccggtncgnnnggangncantgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462293 - DNA, 2281 bp, Homo sapiens
  misc_feature (1956)..(1956): n is a, c, g, or t
  misc_feature (1958)..(1958): n is a, c, g, or t
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctttccgcttccctttttcttatncnctagcccacactttttagaatgaggtctgtcatatacttgattacatatgaaatctcagatgccaattttgtttaatgtgtcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggcccttaaggtggcatcaggatgctcttatgtccttccagaattagcatacacttcactccgctccccttcatctc

SEQ ID NO: 462294 - DNA, 2345 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgcc

SEQ ID NO: 462295 - DNA, 1908 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462296 - DNA, 2015 bp, Homo sapiens
  misc_feature (7)..(7): n is a, c, g, or t
  misc_feature (10)..(12): n is a, c, g, or t
  misc_feature (16)..(16): n is a, c, g, or t
  misc_feature (18)..(18): n is a, c, g, or t
  misc_feature (21)..(21): n is a, c, g, or t
cccggtncgnnnggangncantgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacatgtgcatgcctcgaggagccggactacgtgaccagactgagacgagccacacatgcattcacgacctcaccgctgtgacttatcccagcggtagtcacgtagcagttcgtgggtgtgtggcatgacctcgtccatccccgagcagagctgggatacgcggaggtgtgcacactgctccagactggctgctgcccggtgggggaccggcgatgacccgagtcccgagagtaatatcgctatttcgcgcgcattacaggactgatgcaaggcatggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462297 - DNA, 1438 bp, Homo sapiens
tctagatggatcccctttcgattgtgggactgggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462298 - DNA, 1227 bp, Homo sapiens
ggctggtacaggcctgggagtaagggatgactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaaaaaaaaaa

SEQ ID NO: 462299 - DNA, 487 bp, Homo sapiens
cgaattccgagctcggtaacccgcaggtggttgtgggtaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatctcacggaacagctacagatctatgattgcgcagtcgagcacgtacacc

SEQ ID NO: 462300 - DNA, 4712 bp, Homo sapiens
cggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggcactggagtcagagttgtccaaggaaagggcctcaggcatcccttggtccaggaagaatttctctgatggccgcaggacatttgcttgagacccaagtggcagggatccaaccgcccttggcgctgatgtttgctgagggctcagggcttccctctccagccccggttccaagctgtctgatcccccacgaggaaacttgagcaaacaccctgggctcggtgctggaggagggcgtagcatcttcaagaacagctcagggagggagagctagcaggtagaatgggccaatgagggtgttccttggtgtcctccctgaactgccatctgcagacccagcagggtcctagccccgtcattttgctgcgtggccttggccatgtccattctcctctctggctttctttctttgtttcttcctctatgacatgaagggcttgcccagaccaggggttctcaaacgcggatcacccagagggtttgttaacacacagatttctgggtcctacccacatttctaattcagcaggcctgggtggggcctaagaattagaatttctaacgagtgcccaggtctatgctgatgctgctgctccagggcccatgctgggagacccactcaaaggaccttgaagttcatctctggctatggctccgcaggagggggagacacctcggatgtgatttcccagctgtaatttccatctgcttctcctggggaaggggcctttcagagaatcggggctattgtattggattttcaatctgaccacatgccagtgaaggaacaggctggagtggggtgtggacacagggcctgcgtcagtcactcccctcctgcagctagtaagaggcctcagaatggccagctgccagtggcaccttgtctgggagttagttgggccctttgggactctgtgaagggaagacactaccaaggtcacagtgccttctggaggtcattctaagtcggctctcttgggagggcagcactcagggccctttgggccctcttgaggagaggagagtcctggcagtaaggtaagatgggcttgccaccccccacctttcgcccctgcccaccagcgctccgcgcaaactggtcccctcatactgcagcgcagagttgggtggggctgagaagccatctggttacagcccaccttgtaggaaatgacccagcttgtttcccccacatcatgcttccaggggccgtctctcctgagtggagatgtgagacacacacccctcctccagaccaccctccgctccccaccctggaggcttgagactgctggcactggagcagcccaccaatggacacccaccgtgtgccgttcagcctcccacagtgctgtggagactgcaggaaggaggaggaagcaatggggccagaggccctgggcgccctccccacctcccctggctgaactctcagcaggcactgggggcactttgacccccctcctgctcctctcctcctgtggagagccagatgctggcgacagctggagggcccggccttcctggcacacagttctgcctgcaccagggatggattcattttaataacttcatttcaccctcatgcacactgccgcctcatccctcctttccaccttccccagtagcctggctgctctcctcagctaggacttcgctaacagatttcctcccaaaccttaattctttggaatagccctctggtccctactgttcttgccagatacttctgtgcccgcttggtcctcacaagggcaaggggtccatccaacttcctctggctaagaagacgtcacctctgccccattggcgagcagtgtccccatggtgatgcccccccaccatcacgacgaagtgcgctggcctcccactcttgccatgcacacactcacaggagattcctctgaagaaacctgtccccactctgcccagaccccaaagggccaggtcctactcacaggaggggtgaccaggtgctgggatcatcgagtgagtatgtgcaggagggattgtagagacacaatgaaacagttgctctgtgttgggaagtgatccagtgtcatcgctgggagtgggagacagaaatgttacttccaaagattccgagtcctgtggtactcccaggccacctggtcaggtggtcccaagggacaagctaggtcctcctgaactgcagaggctgccaataaactggcaacacaggtgttgcaggaagatatagctgggtcctcatcctgggtctgtaatttattagacgtgtggctttggacaaatgacataatttcccagagcctccttagataaaaaactagggctttgcttaccttggcgtattgttaggaaaattaaatgagttgctcaataaatgttacttcctcctgtctttttttttctaagatgggttgttgttaaccttggccttgctcctggtgtggacaggggaaagggtcccaggctggaggtaggagacctaggttcctatcctggttccaccccatcatgcatgtggcaaagatttctaattgtcccataatacccattttccctttctccatagtaatgggattctctgattttagctgggcatgtggctgcctgaaataactactgcatttctcagcctccctagatgtagtcatgtgactaagatctggccagtgacatttaagccaaaggtttaggtggcaccttccagaaattgtcagacagctgatgtgcactcttcgtccctttgttccaccctctatcctgcagcctggaataggtacgagactgctgccatcttaga

SEQ ID NO: 462301 - DNA, 1922 bp, Homo sapiens
cggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggg

SEQ ID NO: 462302 - DNA, 5799 bp, Homo sapiens
cggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggcactggagtcagagttgtccaaggaaagggcctcaggcatcccttggtccaggaagaatttctctgatggccgcaggacatttgcttgagacccaagtggcagggatccaaccgcccttggcgctgatgtttgctgagggctcagggcttccctctccagccccggttccaagctgtctgatcccccacgaggaaacttgagcaaacaccctgggctcggtgctggaggagggcgtagcatcttcaagaacagctcagggagggagagctagcaggtagaatgggccaatgagggtgttccttggtgtcctccctgaactgccatctgcagacccagcagggtcctagccccgtcattttgctgcgtggccttggccatgtccattctcctctctggctttctttctttgtttcttcctctatgacatgaagggcttgcccagaccaggggttctcaaacgcggatcacccagagggtttgttaacacacagatttctgggtcctacccacatttctaattcagcaggcctgggtggggcctaagaattagaatttctaacgagtgcccaggtctatgctgatgctgctgctccagggcccatgctgggagacccactcaaaggaccttgaagttcatctctggctatggctccgcaggagggggagacacctcggatgtgatttcccagctgtaatttccatctgcttctcctggggaaggggcctttcagagaatcggggctattgtattggattttcaatctgaccacatgccagtgaaggaacaggctggagtggggtgtggacacagggcctgcgtcagtcactcccctcctgcagctagtaagaggcctcagaatggccagctgccagtggcaccttgtctgggagttagttgggccctttgggactctgtgaagggaagacactaccaaggtcacagtgccttctggaggtcattctaagtcggctctcttgggagggcagcactcagggccctttgggccctcttgaggagaggagagtcctggcagtaaggtaagatgggcttgccaccccccacctttcgcccctgcccaccagcgctccgcgcaaactggtcccctcatactgcagcgcagagttgggtggggctgagaagccatctggttacagcccaccttgtaggaaatgacccagcttgtttcccccacatcatgcttccaggggccgtctctcctgagtggagatgtgagacacacacccctcctccagaccaccctccgctccccaccctggaggcttgagactgctggcactggagcagcccaccaatggacacccaccgtgtgccgttcagcctcccacagtgctgtggagactgcaggaaggaggaggaagcaatggggccagaggccctgggcgccctccccacctcccctggctgaactctcagcaggcactgggggcactttgacccccctcctgctcctctcctcctgtggagagccagatgctggcgacagctggagggcccggccttcctggcacacagttctgcctgcaccagggatggattcattttaataacttcatttcaccctcatgcacactgccgcctcatccctcctttccaccttccccagtagcctggctgctctcctcagctaggacttcgctaacagatttcctcccaaaccttaattctttggaatagccctctggtccctactgttcttgccagatacttctgtgcccgcttggtcctcacaagggcaaggggtccatccaacttcctctggctaagaagacgtcacctctgccccattggcgagcagtgtccccatggtgatgcccccccaccatcacgacgaagtgcgctggcctcccactcttgccatgcacacactcacaggagattcctctgaagaaacctgtccccactctgcccagaccccaaagggccaggtcctactcacactccaacccgttgaccttccccatccactgcccttcaaggcagtctgaaatgccctcagaccgtttagcggtcccgtggtcctccaccctaacccctcagcccagctgggggctgccgggggccttgtctcctccatcagtggagcctctgggacaagtttaccaggctgggggttctttaaggacacagcttggatctccccatcaggctggggaacacctagggccgggggccatgcctccctcatcagactgaggacaccctgatgtcaggggctggatggccccttagactgggggtccctgagggcagaagctatgcctcccctcatcagactggagtctccctgagggcaagaactgtgctatggatgggagggggacagcttgccttttcctaggcatcagagcacctggaggctgcctctgcccttcagctttgctcaaaggcgctgtctgggtctcagcattcctttctcaagtagggtgaatctcctagcactctgtgaagctaataagggggattacccgttaggtcaactggtagcaatgcccgagtctccttctcgatgaagcttaaggcaaaagcaaatgaatatctaggtcccttcccccccttccccccttccctttcctgggatgagcaagcgggaactgagtcaccctgttccccatccttggcaggaatgctggtgaccttgcattgtggcagattcaggtggcgaggcccattgctcgagatgcacctggtgggtgggtggcagggatcctgggggagtgtttatggggacggaggcagctgaagggcagggaggggtgaccaggtgctgggatcatcgagtgagtatgtgcaggagggattgtagagacacaatgaaacagttgctctgtgttgggaagtgatccagtgtcatcgctgggagtgggagacagaaatgttacttccaaagattccgagtcctgtggtactgccaggagaaccgggggctggggtgatgggtaaggagaggcaccattagccccgccaggcagaggcaagatggggtgggggcggcacctgccaattatgccaaagtcttggagtggcagctggcaccatcaccaaggcacaaatgccagcagagacctggcactcacctgggttgtgattccatagggcccctgtctcctgttggtctcccaggctcaaaggctgacctgataattcaagtgaaggatgcctagttcaaggcctcccagttcctcatcccaggccacctggtcaggtggtcccaagggacaagctaggtcctcctgaactgcagaggctgccaataaactggcaacacaggtgttgcaggaagatatagctgggtcctcatcctgggtctgtaatttattagacgtgtggctttggacaaatgacataatttcccagagcctccttagataaaaaactagggctttgcttaccttggcgtattgttaggaaaattaaatgagttgctcaataaatgttacttcctcctgtctttttttttctaagatgggttgttgttaaccttggccttgctcctggtgtggacaggggaaagggtcccaggctggaggtaggagacctaggttcctatcctggttccaccccatcatgcatgtggcaaagatttctaattgtcccataatacccattttccctttctccatagtaatgggattctctgattttagctgggcatgtggctgcctgaaataactactgcatttctcagcctccctagatgtagtcatgtgactaagatctggccagtgacatttaagccaaaggtttaggtggcaccttccagaaattgtcagacagctgatgtgcactcttcgtccctttgttccaccctctatcctgcagcctggaataggtacgagactgctgccatcttaga

SEQ ID NO: 462303 - DNA, 3771 bp, Homo sapiens
cggggactggagcatgggacggcgcgcctgaaggagcaggaaggggaaggaggcctgggaccccgaaaagagaaggggagagcgaggggacgagagcggaggaggaagatgcaactgactcgctgctgcttcgtgttcctggtgcagggtagcctctatctggtcatctgtggccaggatgatggtcctcccggctcagaggaccctgagcgtgatgaccacgagggccagccccggccccgggtgcctcggaagcggggccacatctcacctaagtcccgccccatggccaattccactctcctagggctgctggccccgcctggggaggcttggggcattcttgggcagccccccaaccgcccgaaccacagccccccaccctcagccaaggtgaagaaaatctttggctggggcgacttctactccaacatcaagacggtggccctgaacctgctcgtcacagggaagattgtggaccatggcaatgggaccttcagcgtccacttccaacacaatgccacaggccagggaaacatctccatcagcctcgtgccccccagtaaagctgtagagttccaccaggaacagcagatcttcatcgaagccaaggcctccaaaatcttcaactgccggatggagtgggagaaggtagaacggggccgccggacctcgctttgcacccacgacccagccaagatctgctcccgagaccacgctcagagctcagccacctggagctgctcccagcccttcaaagtcgtctgtgtctacatcgccttctacagcacggactatcggctggtccagaaggtgtgcccagattacaactaccatagtgataccccctactacccatctgggtgacccggggcaggccacagaggccaggccagggctggaaggacaggcctgcccatgcaggagaccatctggacaccgggcagggaaggggttgggcctcaggcagggaggggggtggagacgaggagatgccaagtggggccagggccaagtctcaagtggcagagaaagggtcccaagtgctggtcccaacctgaagctgtggagtgactagatcacaggagcactggaggaggagtgggctctctgtgcagcctcacagggctttgccacggagccacagagagatgctgggtccccgaggcctgtgggcaggccgatcagtgtggccccagatcaagtcatgggaggaagctaagcccttggttcttgccatcctgaggaaagatagcaacagggagggggagatttcatcagtgtggacagcctgtcaacttaggatggatggctgagagggcttcctaggagccagtcagcagggtggggtggggccagaggagctctccagccctgcctagtgggcgccctgagccccttgtcgtgtgctgagcatggcatgaggctgaagtggcaaccctggggtctttgatgtcttgacagattgaccatctgtctccagccaggccacccctttccaaaattccctcttctgccagtactccccctgtaccacccattgctgatggcacacccatccttaagctaagacaggacgattgtggtcctcccacactaaggccacagcccatccgcgtgctgtgtgtccctcttccaccccaacccctgctggctcctctgggagcatccatgtcccggagaggggtccctcaacagtcagcctcacctgtcagaccggggttctcccggatctggatggcgccgccctctcagcagcgggcacgggtggggcggggccgggccgcagagcatgtgctggatctgttctgtgtgtctgtctgtgggtggggggaggggagggaagtcttgtgaaaccgctgattgctgacttttgtgtgaagaatcgtgttcttggagcaggaaataaagcttgccccggggcactggagtcagagttgtccaaggaaagggcctcaggcatcccttggtccaggaagaatttctctgatggccgcaggacatttgcttgagacccaagtggcagggatccaaccgcccttggcgctgatgtttgctgagggctcagggcttccctctccagccccggttccaagctgtctgatcccccacgaggaaacttgagcaaacaccctgggctcggtgctggaggagggcgtagcatcttcaagaacagctcagggagggagagctagcaggtagaatgggccaatgagggtgttccttggtgtcctccctgaactgccatctgcagacccagcagggtcctagccccgtcattttgctgcgtggccttggccatgtccattctcctctctggctttctttctttgtttcttcctctatgacatgaagggcttgcccagaccaggggttctcaaacgcggatcacccagagggtttgttaacacacagatttctgggtcctacccacatttctaattcagcaggcctgggtggggcctaagaattagaatttctaacgagtgcccaggtctatgctgatgctgctgctccagggcccatgctgggagacccactcaaaggaccttgaagttcatctctggctatggctccgcaggagggggagacacctcggatgtgatttcccagctgtaatttccatctgcttctcctggggaaggggcctttcagagaatcggggctattgtattggattttcaatctgaccacatgccagtgaaggaacaggctggagtggggtgtggacacagggcctgcgtcagtcactcccctcctgcagctagtaagaggcctcagaatggccagctgccagtggcaccttgtctgggagttagttgggccctttgggactctgtgaagggaagacactaccaaggtcacagtgccttctggaggtcattctaagtcggctctcttgggagggcagcactcagggccctttgggccctcttgaggagaggagagtcctggcagtaaggtaagatgggcttgccaccccccacctttcgcccctgcccaccagcgctccgcgcaaactggtcccctcatactgcagcgcagagttgggtggggctgagaagccatctggttacagcccaccttgtaggaaatgacccagcttgtttcccccacatcatggtcccaagggacaagctaggtcctcctgaactgcagaggctgccaataaactggcaacacaggtgttgcaggaagatatagctgggtcctcatcctgggtctgtaatttattagacgtgtggctttggacaaatgacataatttcccagagcctccttagataaaaaactagggctttgcttaccttggcgtattgttaggaaaattaaatgagttgctcaataaatgttacttcctcctgtctttttttttctaagatgggttgttgttaaccttggccttgctcctggtgtggacaggggaaagggtcccaggctggaggtaggagacctaggttcctatcctggttccaccccatcatgcatgtggcaaagatttctaattgtcccataatacccattttccctttctccatagtaatgggattctctgattttagctgggcatgtggctgcctgaaataactactgcatttctcagcctccctagatgtagtcatgtgactaagatctggccagtgacatttaagccaaaggtttaggtggcaccttccagaaattgtcagacagctgatgtgcactcttcgtccctttgttccaccctctatcctgcagcctggaataggtacgagactgctgccatcttaga

SEQ ID NO: 462304 - DNA, 1442 bp, Homo sapiens
acgaggccagtaagttgttgaaaagatgattgtgaatctgcaaaagagaatctctagcctggcagatagtaaacactcattaaatgtaaatggcagagtccagattttgcccaaacctgtaaagttcaaagcaaaacagaaagttggccatagatcttatgaagagagccaagctcgacagtttgggtcaagaaagaagtggtcccaagatttctccaaacctccttatcctttcctttttcataagggttacctaaaccccagagagcaagataaggtaggaggatgcatccacaaccttgccttggcgtcatggaagcagagtacacttccccaattcaataaacttgtcttatccagtggaataagaacagtacttggaaattcctgtgctgtatgatctgctgccagttacttcagatttgaaacacagtgccttattaaggactaaatgaatgattgtctatggattttggtggaccagatataacgaatacttaagcactgtccatccattgccaacccattgtcctcatcccacacttgacgtgggttgctataacagaataccatagactgggtggcttataaacaacaaaagtttatttctcacagttctggagcctgggaagtccaaatattagcagagtcagtgtctgttaagggctcgtttcctcttcattgacttccatcttctccctgcatgctcacatggtggaaggagctagagatctctcttaagcttctcttatgagagtactgatcctattcatgaaagctccagtcagtatctaatcacgtaccaatggctccagcttctaacaccattacattgggagttaggatttcagcataggaatttgaggagacacattcagtccgtaacagtctccccagccatttttgcttccaaccctctcccctcaattttttttctttccttttcttttgttttcaatagagacatgggctcactctgtcacccaggctggagtacagcggtggaatcacaacacactgcaacatcaaactcctggtctcaagcaatctgcccacctcagcctcccaaatctccaggattacagctactggagatatctaagttttcataagagatcatcagaagaaaatgaagatccaggctctctttcagctgagaaaacgcatccacaaaattccaaagaatacctggtgagattaaagaaaatgtttctcaagcacgaaaagtgtaagaattgacatagtaaatatgcaggcactcattgatcacttaagaaataaaaattgaaaaataatgccatgaaattatttgcattccccattcttttttaaaaaaatgaaatcattgtactttacaattttttaactcaatatataagataaacatactagacaatattattttagaaatcagagttgaataagttacccatattacagaa

SEQ ID NO: 462305 - DNA, 1436 bp, Homo sapiens
acgaggccagtaagttgttgaaaagatgattgtgaatctgcaaaagagaatctctagcctggcagatagtaaacactcattaaatgtaaatggcagagtccagattttgcccaaacctgtaaagttcaaagcaaaacagaaagttggccatagatcttatgaagagagccaagctcgacagtttgggtcaagaaagaagtggtcccaagatttctccaaacctccttatcctttcctttttcataagggttacctaaaccccagagagcaagataaggtaggaggatgcatccacaaccttgccttggcgtcatggaagcagagtacacttccccaattcaataaacttgtcttatccagtggaataagaacagtacttggaaattcctgtgctgtatgatctgctgccagttacttcagatttgaaacacagtgccttattaaggactaaatgaatgattgtctatggattttggtggaccagatataacgaatacttaagcactgtccatccattgccaacccattgtcctcatcccacacttgacgtgggttgctataacagaataccatagactgggtggcttataaacaacaaaagtttatttctcacagttctggagcctgggaagtccaaatattagcagagtcagtgtctgttaagggctcgtttcctcttcattgacttccatcttctccctgcatgctcacatggtggaaggagctagagatctctcttaagcttctcttatgagagtactgatcctattcatgaaagctccagtcagtatctaatcacgtaccaatggctccagcttctaacaccattacattgggagttaggatttcagcataggaatttgaggagacacattcagtccgtaacagtctccccagccatttttgcttccaaccctctcccctcaattttttttctttccttttcttttgttttcaatagagacatgggctcactctgtcacccaggctggagtacagcggtggaatcacaacacactgcaacatcaaactcctggtctcaagcaatctgcccacctcagcctcccaaatctccaggattacagctgtgagccaccatgcccagccttcccctcaaattttgtactgtctacaatgttcagccaccactactgtctgcgtatccttgtttcagaagactcataccacttctacataggcttgctcagttcagttactttcatactaaatttaacagcaattcctctagttctttaaaatgtggaatatacacacctctgactgatttccagtgaacatgcagatttttctgtatttttttaatctactggatgtttaaacgggattttaaaagacagagagggaattatttgtgttcctttcattttgccaaaagtcttgctattgtttttttataattttgattgtaaacctcc

SEQ ID NO: 462306 - DNA, 1272 bp, Homo sapiens
acgaggccagtaagttgttgaaaagatgattgtgaatctgcaaaagagaatctctagcctggcagatagtaaacactcattaaatgtaaatggcagagtccagattttgcccaaacctgtaaagttcaaagcaaaacagaaagttggccatagatcttatgaagagagccaagctcgacagtttgggtcaagaaagaagtggtcccaagatttctccaaacctccttatcctttcctttttcataagggttacctaaaccccagagagcaagataaggtaggaggatgcatccacaaccttgccttggcgtcatggaagcagagtacacttccccaattcaataaacttgtcttatccagtggaataagaacagtacttggaaattcctgtgctgtatgatctgctgccagttacttcagatttgaaacacagtgccttattaaggactaaatgaatgattgtctatggattttggtggaccagatataacgaatacttaagcactgtccatccattgccaacccattgtcctcatcccacacttgacgtgggttgctataacagaataccatagactgggtggcttataaacaacaaaagtttatttctcacagttctggagcctgggaagtccaaatattagcagagtcagtgtctgttaagggctcgtttcctcttcattgacttccatcttctccctgcatgctcacatggtggaaggagctagagatctctcttaagcttctcttatgagagtactgatcctattcatgaaagctccagtcagtatctaatcacgtaccaatggctccagcttctaacaccattacattgggagttaggatttcagcataggaatttgaggagacacattcagtccgtaacagtctccccagccatttttgcttccaaccctctcccctcaattttttttctttccttttcttttgttttcaatagagacatgggctcactctgtcacccaggtgtctgcgtatccttgtttcagaagactcataccacttctacataggcttgctcagttcagttactttcatactaaatttaacagcaattcctctagttctttaaaatgtggaatatacacacctctgactgatttccagtgaacatgcagatttttctgtatttttttaatctactggatgtttaaacgggattttaaaagacagagagggaattatttgtgttcctttcattttgccaaaagtcttgctattgtttttttataattttgattgtaaacctcc

SEQ ID NO: 462307 - DNA, 3454 bp, Homo sapiens
atccctggaggagaagggagcccacagtccccggagagttcctggaagaggcccctgtgtgtccgatgaggtcacaaagcccctccaccagaggctcctcccccagacccctgctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatcccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaagtcccactcagacccccgccccgacagaactcacacccaaatccgcttgcctggccagggacatgtggttgagagcccttcacactgtgtctcagctgacagccctgatggcttctttctgggctcctgcagctccctggacccgtgcctgtggcatcaggacacggaagacctcatggactctgggggcagcactttctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactcagcgagtcgcacctcggtgcctgtgtgcacgcgcaggcccccgagggggcgtcgggggagcaaggggtggggtgggggcgcccctaccagccccgcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgggtgaccctagacaagcttcttgacctgtgtgagcccgaggttccccaaggcaaaccaagatggctcagggccccattatcagaggaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtcccc

SEQ ID NO: 462308 - DNA, 3853 bp, Homo sapiens
atccctggaggagaagggagcccacagtccccggagagttcctggaagaggcccctgtgtgtccgatgaggtcacaaagcccctccaccagaggctcctcccccagacccctgctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggatgatcccctggacctcgtccacctctgcgtccatgacctctctgcctggcgcctgaagctgcgcctggtctcgggccgccagtactacctggccctggacgcccctgacaacgaggtgggcttcctgttccactgctgggtccgcctcatcaacctgcttcaggagccggctcccacctggacccccaggaccacgcgcacggcccccctggatatgccgctggccgaagcgcctgcctccacctggcacctgcaggaccagcccatcagcagacatgcagtcagggttgctgagcgcaactttccgcataagacggtggctgctcagagacagaggaaggccaaggcgctcaagcgcagtttcaagtctcaggccgtgggcgactctgtgcccctcatctggtcgcagctggagcatgctgacgtcaggaagaaacctgcagaaaagaagtcccactcagacccccgccccgacagaactcacacccaaatccgcttgcctggccagggacatgtggttgagagcccttcacactgtgtctcagctgacagccctgatggcttctttctgggctcctgcagctccctggacccgtgcctgtggcatcaggacacggaagacctcatggactctgggggcagcactttctgtacctgcttcatcgtggaaacccccacctggattggctcctccccagaaggccccagctgcgtcagctcctccccggaaggccccagctgtacctgctccatcccagaaggccccagccgtacctgctccatcccagaaggccccagccatacctgctccatcccggaaggcctcagctgcatggcgctgagcccgcctgcctcacgggggaagctccctggcgattttgacgtgttgccaacaggaattcctggaagagccgtgctggagagaagccagtctggagggaaaccggagccggtggtgacggtgcgcacccaggagacagacgtggtggagatgacgactcaggccaagtccccggagtcgcccttcaccgtgaccaagaaggagtccaaggacatcctgattagccaaaccaaggaggtgaccctggaggccttcaggggccaggggaagttggaggactgggcccactgggcgaagcttgaagagaggtccccggacctgcctggcgtgagatccaaggagttggagcagcggaagagatgggtcaaggccaaggaactggccgtcgagggcccctcccaggagcacagcaggcccttctctgtggaagcgctcaccctcaccaagctcatgatcacggccaactccaaagagcagccctcgaaatccgctttggtctcacttccctcctggctcttggcgactccgcaggcgtcggccacgtcaatgatggcttcagtgccctcccgccccggccagctgtccttactggaggggaagccagtggtggtcagagagcagccagagtcgcacacctgggtgaaggagggcaagcggccatggggcgagatgaaggagcagccatggggcgagatgaaggagccaccctgggaccccaaggggccacccaaggtgccctttcgctccaagcccacctctgccagtctgaagagggaaggaatctcccaggcgcctatccccctgaccgcctcaccgtgggaggacttacggccatcgcccctctcggagaccctcatctcaaagatggaggccacagccagggcgtcccagcagcccaagagggtgtcgcaggagcccatgaggatgccagcccagcaccccctggccactgtggggaagcggaatgttgaaagccgcttggggggatttgccccctctggtagataccagaactatggatatgcctttatatattggggggcgggggggggcgggggcgagcccgtggagccgcccaacttcgcagagattaaagcttgagcctgagactcagcgagtcgcacctcggtgcctgtgtgcacgcgcaggcccccgagggggcgtcgggggagcaaggggtggggtgggggcgcccctaccagccccgcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaac

SEQ ID NO: 462309 - DNA, 1387 bp, Homo sapiens
atgatggtcatcgttatcttcatcatgacgggcttcacagtctccagggtcccccccacccccatgatggtcatcgtcatcatcttcatcatgatgggcttcacagtatccagggcctgcaccacccccacgatggtcatcatcatcatcatgacgagctccacagtatccagggcctgcaccactcccacgatggtcatcgtcatcatcatcatcaccatgatgggctccacagtatccaggacctccaccacccccacgatggtcattatcatcatcacgatgctggggcttcacagtctccagggtccccaccactcccatgatgtatccagggcctacaccacccccacgatggtcatcgtcatcatcgtgacgggctccacagtatccagggcctccaccacccccacgatggtcatcatcatcatcacgatgctggggcttcacagtctccagggtccccatcacacccacgatggtcattgtcatcataatgatgggctccacagtatccagggcctgtaccacccccacgatggtcatcatcatcatcatgatgctggggcttcacagtctccagggtccccaccacccccacgatgggttctcaccacccccacgatggtcatcatcatcatcatgatggtcttcacagtctccagggcctgcacctacccccatgatggtcatcattattgtcttcgctgtggaggggctttgcagtgtttcgatggtggtcatctcatcgccatcaccatctcatcctgagtacctcccttgtgcgagctgtgtgctttgttctttgccagcatgaccttgtttgatagactcaaagtgtttaaacttatgtaattcattaaaaacgagttgtgtttctccctattttctattttgtacatgaacaaaaatgtattctgttgccttggaagcttagaaggaagactgctgggcctcagctttggttgctctattgatatttggaggaaagtgcatggcggttggtcatcgggggaaagtttaaagtggaaatcacattccgtggctttgaatgtctctgttgaatgctcaggcccatcacaacagaggcactggcctgagaggaaaaacatgatttagctacattttattctcctggactttagctgttaaaaccatccttttctcctatctttctgatattaattgatatatctaaaaactgttctacattatttcttgctgctgagagaaatggcagtgaatttaatgaaaacagagtggcaggttctaaattgtggcagcttgctggacctgtggacccttcccacttaacgctgttagctgaaatgtaaagtgaagctatatttatggaagaaatttaagtttgacaagaaaagaacaaata

SEQ ID NO: 462310 - DNA, 6345 bp, Homo sapiens
tccaagatggtggcgctaggagccgcgacccagtgatagcggccgtggaggggcccccgaccgagcgggaggttgggggtagcctggaggtgagaccccgctgcgttcacagagctggcggccgcggcgcctgcgtccaccggcaagcgaggagtggagcagagctcatatgcctatggggagaggcctgggggaccgcaggaggatgtaggcgccgggtgcgcatgactgggccttcttgctctcggtcggcttcttggtctcggcgtgccccattcccggccctgtcccgctactcttgcctgttccagttccctcctgtgggtaccgctaacggcatcttcccgaggcccagaatccaccgtcaggcataaattgattattcctcgcccacatctgtgccagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtgtaatgaatgtgggaaagactctaatcaaagttcaaatcttattatacatcagagaattcatacaggaaagaaaccttatatatgtcatgaatgtggaaaagacttcaatcagagctccaatctggtgagacataagcaaattcacagtggtgggaatccctatgagtgcaaagagtgtgggaaggcttttaagggaagctcaaaccttgtcctgcaccagagaatccacagtagggggaagccatatttatgcaataaatgtgggaaggctttcagtcaaagcacagatcttattatacatcacagaattcacactggagagaaaccctatgaatgttatgactgtggacagatgttcagtcaaagttcacaccttgtcccacatcagagaattcacactggagagaaacccctcaaatgtaatgaatgtgaaaaagccttcaggcagcattctcaccttactgaacaccagagactccacagtggagagaaaccctatgaatgtcacagatgtgggaagaccttcagtgggcgcacagcttttcttaaacatcagagattgcatgctggagagaaaattgaagaatgtgagaaaaccttcagcaaggatgaggagcttagggaagagcagagaattcaccaggaagagaaagcttattggtgtaatcagtgtggtaggaatttccagggcacctcagacctcatcagacatcaggtaactcatacaggagagaaaccatatgaatgtaaagaatgtgggaaaactttcaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgaggagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctcgtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctcaaaaaaaaaaaaaagtctaactcttctgcttgtctttacaatgctgtacagtgagagctaatgtttataaggataaacaggatacttacagggatttgaaggtaatttaattcagtggtttccaactttttaatcaccaaggccttctttttactcccctatgtcctgtgtcttaaaagattatgtttaccaaactgcatttattaaagaattatattttgctacataaaggcatgtacaacacaaatcatgcttctgactggcaccatgtaggcagacctaggtactaaaattccagcccaaagcaaataatttaccattttcattagtctttttattccttttgtgggcaaacatatcgtctatgttaggctttttgaaatattaactatgacttgtaaactccagattaaaaactaaccaattcatctttgatggagcttgaatcaaactaagggtattggacttttgaaagattgaaatttttgttacagtatggaatgtttttaactgaatgttgaaataaaagttatttaagaattacttagtgactgtttagtatgtgccaggggccgtaattagatggggctgaagaaagatagtcattgttgaatcttcttcaggtagaccaggtcctccttgaggttctcaggctgcatctccaggttggctccggccagggtcagcttgtccagcccctggtgcagctccagagacccagcctcgcttggtgcagaagtcattggcagccaggtgggcatcatccacctgtagccagcacttctccattctgccaacgtctccggcctggtgagtctggatgtgagcgcatcccagggggcccaaggcacagagagagagaggaacggggtggagggagggaagtgtgtgcaggggccaggagcgccaggctgctcgggcttcccggcccctgcagcccgccaggagctgtggccaaggcagaggcctgccctgctgctgctggcgctgtcacctccctgtggtcctgccttctgggtccttgagggcctcctgtcatctggaactggaaataagttagtgaagcgacgttttgtgaatatttattggcctttgcgtctttgtcttcattttcagtgctggcttttctgttgggtcatttgtgttcttatgttgatttgaagaatttaaaaaggtattctataaattaatcctttatggggtcatttctagtgcagatagttgtttcttagtctggtcattgtaccgtaattttatttcacatttctttcttgctggtaaataagaatctaattgattttatatattgattttgtatcttgttacctggtttaattcacatattcataggcatcatttttggattgtggtgggtttttcatgtacttatgtacatgtagttatgtacttatgtacttaaatacttaacgtacttacatacttatgtagttagtgtcagccacatataataacacctatattgcttaaatgttggttcttacacctttatttttctttattttcttcttttattgtccccatcacacctcctgaacacggtgtgtctggttctgattccagggaacaggtttcagtgatcctgtattccttatgtagtttattataatttcattttagacaaacaatgagattaaggaagctgccttcttttacatatgctaagagttatttatgactaattgttgaatttgaataaatgcttttttttacatatactgta

SEQ ID NO: 462311 - DNA, 1440 bp, Homo sapiens
taggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtccctgcctgcctcccagcagcccgcgtgcgcccagctcctccctcacggtggcctgttgatgccaactcatgcctctggaccctgcacagagcgtgacg

SEQ ID NO: 462312 - DNA, 2257 bp, Homo sapiens
gggcgactactactactaaattcgcgggcggatcaatcttcctgtgccatccaggctggagtgcagtgatgtgatcatagctcactatagctttggccttctgagatcaagcaatcctcccatctcaacctcccaagtagctgggactacacacgcatgtcacccatgcccagatcatttttgtagagtcagagtttcaccgtggtggccaggttggccatgttggccagatggggtcttcttttgttgcccaggctggccacaaattcctgggctcgagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtccctgcctgcctcccagcagcccgcgtgcgcccagctcctccctcacggtggcctgttgatgccaactcatgcctctggaccctgcacagagcgtgacg

SEQ ID NO: 462313 - DNA, 1689 bp, Homo sapiens
taggggtgctacaagttgaccactgcagcagtaaagatgactctgaagaatggcgtgggttggttcctttcaaatgcacttgagcagcggtctccaaccacagggccacagagctggagctggatctaccatgaaagacttgtgaatccaggaagagagactgactgggcaacatgttattcaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtccctgcctgcctcccagcagcccgcgtgcgcccagctcctccctcacggtggcctgttgatgccaactcatgcctctggaccctgcacagagcgtgacg

SEQ ID NO: 462314 - DNA, 2225 bp, Homo sapiens
gggcgactactactactaaattcgcgggcggatcaatcttcctgtgccatccaggctggagtgcagtgatgtgatcatagctcactatagctttggccttctgagatcaagcaatcctcccatctcaacctcccaagtagctgggactacacacgcatgtcacccatgcccagatcatttttgtagagtcagagtttcaccgtggtggccaggttggccatgttggccagatggggtcttcttttgttgcccaggctggccacaaattcctgggctcgagtgatcctcccacctcgtccttgtagagatgagatttagttatgtcgtccaggctgatctcaaactcctgggctaaatcgattgtctcacctcagcctctcaagtatgttatgaaggttatatgttaggaagggtcccaggaggtaaacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtccctgcctgcctcccagcagcccgcgtgcgcccagctcctccctcacggtggcctgttgatgccaactcatgcctctggaccctgcacagagcgtgacg

SEQ ID NO: 462315 - DNA, 1403 bp, Homo sapiens
cagagtccaaacagtgcccagagtccaaacagtgcccagagtccaaacagtgcccagagtccaaacagtgcccaggtgcttgccactatgcccaactaacatttggaattttcgtatacgtggattctagaggggtgacagcgaaacgtgggaccatccagttgcaggaaaacaagcttgacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcccgcctgccagtggcctcttcaggcccatggggctcattcctgacaacggcctttccaggcccagtttttcccttccggcggcctctccgggcccagaacctcctcaagtcagcctctccagacccacttgcaccctccgggcgttctctccgggcccagctcttcttcctggttgggtctccaggcccgattcctgcctctcaacaacctctttggactcagtgcctacccatctcctggcggccttggtcggcccacagcttcctcaagccaagctccccaggcccaggtcaggcctcacggtggcctctccaggatgagctcctgccctccgatggcatctccaggccccaaatggtctccggtcggtgggctcctccacgccaaggttgggcctcccggcgactgccgcaggcccaagttgtcctgaagtcgggctctcccggccctgcctcccagcaagtaagcaagctcttttggctcaactcctgcccagctcccaaccgcctttgtaggccccgaactttctccagccaagctctgagggcccacctcctgcctcctggtggcctgtacagttctagcactggttggagaacagcctctgcaggccccgccttgcctcccaggggcctctccaggccaagctcttgcacccacggcggcctcccggggcaagtccctgcctgcctcccagcagcccgcgtgcgcccagctcctccctcacggtggcctgttgatgccaactcatgcctctggaccctgcacagagcgtgacg

SEQ ID NO: 462316 - DNA, 1053 bp, Homo sapiens
catcatgacaggaattaattccagcaagaattatcagtggatagccaggcgcagtggcttacgcctgtaatcccagcactttgggaggccgaggcaggcggatcacgagcatgagccaccgcacctggcccgggaagtctatatttaaaaagaaagtggtatctgagttaggtggctgtcatctgtaatcccagcattttgggaggtcaaggctgaaggataggttgagctcaggagttctggaccagcctggaacatagtgagacaccccccaatctctacaaaaaaaaaattcttaattctaatgttcaaacgttgttttaggctgggcgcagtggcctgtaatcccaacactttgggaggctgaggcaggcatatcacttgaggtcaggagttcaagaccagcctagccaacatggtgaaaccccatctctactaaaaatacaaaaattagctgggcatggtggcaggtgtctgtaatcccagttactcaggaggctgaggcaggagaatcgcttgaagccaggaggtggaggttgctgtgagccaagatcatgccactgaactttagcctgggcgacaaaacaagactgtctcaaaaaaaaaaaaaaagaaagacatcagaggacgcttataaaagtgagacatgagacagagagaaaagcccaaggaggttccttatttaatgttttcaatcttctcccaatgcatggagcagctcctgcctcttagaacatgggccatgcttctgagtgcctgctgttccaaagtctgccatccagagggacagacagacattaaaacaaagtagcagaacagctttggcaaggtgccctaggaatttataatacagtaactaatccagtctagaaagctcaaaatacactttctctcctggaattgacccagagctaaagccaccaattgaccaaatgcctgctaacagtgcccatgtttaaagtccaagatcccccaggtgacagattaattagtgactctctcatgcaaaccttggatagaaacattctacttcaactatccaggctccttatc

SEQ ID NO: 462317 - DNA, 3035 bp, Homo sapiens
gtcatccgcgggcggtcaggaggccgtgggggaagaggaggatctggaagagatggaggacctgcgggagttaggatggggggcgggttctgcaggacagctcgcctccctgaggcttcccaatgttcctaggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcggaaccagagcacccagcctcccagctcttacctgaccttcatccatcctttccacagatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggaggaggatgttgtagtgagctgagatcacgccactgcactccagcctgggcaacagagtgagactccatctcaaaaataaaataaaaggccaggcgcagtggcttacgcctgtaatcccagcactttgggaggccgaggcaggcggatcacgagcatgagccaccgcacctggcccgggaagtctatatttaaaaagaaagtggtatctgagttaggtggctgtcatctgtaatcccagcattttgggaggtcaaggctgaaggataggttgagctcaggagttctggaccagcctggaacatagtgagacaccccccaatctctacaaaaaaaaaattcttaattctaatgttcaaacgttgttttaggctgggcgcagtggcctgtaatcccaacactttgggaggctgaggcaggcatatcacttgaggtcaggagttcaagaccagcctagccaacatggtgaaaccccatctctactaaaaatacaaaaattagctgggcatggtggcaggtgtctgtaatcccagttactcaggaggctgaggcaggagaatcgcttgaagccaggaggtggaggttgctgtgagccaagatcatgccactgaactttagcctgggcgacaaaacaagactgtctcaaaaaaaaaaaaaaagaaagacatcagaggacgcttataaaagtgagacatgagacagagagaaaagcccaaggaggttccttatttaatgttttcaatcttctcccaatgcatggagcagctcctgcctcttagaacatgggccatgcttctgagtgcctgctgttccaaagtctgccatccagagggacagacagacattaaaacaaagtagcagaacagctttggcaaggtgccctaggaatttataatacagtaactaatccagtctagaaagctcaaaatacactttctctcctggaattgacccagagctaaagccaccaattgaccaaatgcctgctaacagtgcccatgtttaaagtccaagatcccccaggtgacagattaattagtgactctctcatgcaaaccttggatagaaacattctacttcaactatccaggctccttatc

SEQ ID NO: 462318 - DNA, 2158 bp, Homo sapiens
tgggtggtggagaaaattccccgaccccttgcgcttcccaggaaatgctcggaacttctttacgtttttcaaacgcagctggctctgaaactgctccagtgtctgaaagtgacggatgcgcctcatttctatggcctgccgtcccttgagcggaccttacgagggatggctaacctcactgcgtttccgggatggagctcacactctcctctcacaaagcctctagatatctgtgtgaagtacttgtcaggtctccttgaggtcattacttctttttatgtggagcgtggaggaaatgctatgtccttcatgggaaaaggtgttacaaagagcacaattctttgcttgcttcacttatcccatgagatgatggcccaggctgggagcttggagtggatgtcactttggttcttgcctttgggtagtcatagtgaagaacatattcctactcaacaaggattggcttggttgattccattatgggttgatcgggacccagaggtgagattcacttcactgggattaggatcagcactgaccacccttgaaacgggctgtgtggccttagcaaacagttgtcagaacatttccggtgggctctggggaactgtggtgaacattcttctggaccagtcagaatgtagtatggtgcgccgggaggcggcatttattcttcagaatctccttgtaattccaatgcctacagaaattataaaggattatacttggcagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatgggagaaagaagcaagcctctcctcgcaaacaaggccagccagctttctcaagaggattttctttttctgatcgtcacagcattgcagatgctaccctcatacagacatgtgtccaggaactcagagccctgctgccttcatcacctccagctgaacacactcaggctcagtgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaactaaaaattgactaataattgctgcttacagacttttatcagtctcatgaatattaattttaggagttgaaataagacactgtgtcctggttgtttctctctttttttaaattttaactgatgtaaaatttggctctgtcagtgcaaatccttattttcaaaactttctgttat

SEQ ID NO: 462319 - DNA, 460 bp, Homo sapiens
gaacttttaaaaaatatatgttcatttttagaaaaagtcattactgtgcttgctgcctgtctggaaagtgagaatcaaaatgctcagaggattggagcagctgccctttgggctctgatttacaattatcagaaggtcagttttaaaaatcattgttacacctggggagcaaacaacaaggtataacccaggtataaactcttaggatacatccaaaggtgtcaagagttacagcaaaagaaaaaagacaaaattaaagatccatgttccctttgctgattcatacaattagtaaaccatcagttgaaatctttttatttaatcatttcaacagaatgtctcagtttaggaagaggatctctggaactgacttttttcctctttaattttaaattggatttactttattattgcaattttagtatagattgtttcttctaaaagacgtatcaagggaaaa

SEQ ID NO: 462320 - DNA, 2202 bp, Homo sapiens
tttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtctgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaa

SEQ ID NO: 462321 - DNA, 1565 bp, Homo sapiens
ggggaatgtgtccccagaaggagaaaggaggaaattgatgacagttctcctgttcagcagttttacaaggacccattttaataagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaa

SEQ ID NO: 462322 - DNA, 2404 bp, Homo sapiens
tttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtctgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaaaaaaaaaaaaaaaaaaaacaagaaaaaggggggggcataaaatatcctggaggggacaaattagcgtaccagttttgagaaggggccatgggggggaaaagcgggaggggtaaaggggctggaacgatcgggcttgaggccctcggggacatggaccacggaaacggaacatatgttgtgagttcgggatgggttatacagg

SEQ ID NO: 462323 - DNA, 1881 bp, Homo sapiens
tttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtctgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaaggccaagataaattgcagaagttgagagcatttataagaattgagtctccttttcctctactgtttcttctccctgaactcctcagaagatactttgttatcaccacataaatagaaagttcggtctttctaaggaaatggaaagatcaatcttaccaaggaaagatgttttcagtggcacgttggagccagcctcctactgactcatgagtgtcatcttaaatttgcaggaattttataaaaattccagttgatgttacattgttattttgaaatcagccacagtgggcatatcacaccacgtaattcagcgaactgtacaaatcttggatcttttctaccctcaccacaatcagttgtttatttaccagcacatggctggatattttcttcatgtatatgttcatgtatgtcatatatgtatatatatttgaatatattttcttcatatatgtattcatatacatgcatcacttccaaaatgagacattctcttgaactggatatatgtgattagcatccataagaatgagagattctgcatatgt

SEQ ID NO: 462324 - DNA, 450 bp, Homo sapiens
gacaagttatctcccatttctaaaattctgttcctttacacaggcctttatttagatgttttctttagcaactattaaaaaccctagtatgtttattttattctttttttaaaaataaacctggtgtcttaaagtgctttagtgagataattaggccctcagtgaggacagtatatctattaggttgactgtagacaccaacattagcctccattgctaatttgcagttcacaggttaatggcctagtcattttgttagacagatatgctttgccacttagtgtcttcaaaaactaaacagggaaactgagaagacattgtgataggctgttatttttgaaggttgcagttctctttgttggtcaagttgtggacaacaccctgttcaagctacacatagaggagccgtgagcaactctctgatgctgtgtatcctaaagttggcttccc

SEQ ID NO: 462325 - DNA, 328 bp, Homo sapiens
gttaatttaaaaaaatattgattttgtaacttgtttattttttaaaaaatgcaaaatattctggaatgctattacatcaagaacttagagctttaaattatatataaatcctgttcatatgtatttgtttatgtgtgtgcctcctaagtatagtaccaagtttcataaactagtatttctgtactcttatttttctatctcagctttcccaaactcagaagcaaaccctctaaatgcctattatttgaaatgtcttgaaaacctcgtgcagctccttaattcttcctgagtgccatgggatgctacaccttgaagctgacagtcatca

SEQ ID NO: 462326 - DNA, 346 bp, Homo sapiens
cctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaac

SEQ ID NO: 462327 - DNA, 997 bp, Homo sapiens
aattaggtaggtacgggctggggcgaatcggccgaggtgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaa

SEQ ID NO: 462328 - DNA, 912 bp, Homo sapiens
acgcgtccgcggacgcgtggtgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaa

SEQ ID NO: 462329 - DNA, 1650 bp, Homo sapiens
aagcttactagaccatgcgtttggaggcgtcgggaccagtaaggtatagtagaactagtggtcataagctggtgtgtctctagtgagatcgcatggtctctgactgagtgcttggattctctacacaataaataaacgcgcacggcggccatccgagcggtacttgagcggaatccagcatggagttctgcatggtcatgacgtggcatctatctgcagtggagtccaacgcgaggtcggtatcaaattacagccccgcacactgtgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaa

SEQ ID NO: 462330 - DNA, 2336 bp, Homo sapiens
tttttgttactccatctcttctttcagcaatgtgcagcctcttggacaacctcttgacgattgctcccagagacactgcaaaggcttttcgacaagctcatctcatagaacttctctgtagcattgcagatgctaccctcatacagacatgtgtccaggaactcagagccctgctgccttcatcacctccagctgaacacactcaggctcaggtttcctttctcctggaatacctatcctctttgtccaggcttctgcagtcatgtttattggtggagcctgaccttgtgattcaggatgagcttgtgaaacctcttatcaccaatatcattggaattctcaccatatgtaccaaagatgtattagataaagagttaatatcagctttttatcacacatggacacatttatttaatcttctggccatgctcctgaggaaagctggtgccatcacactcccgtctgttaccgtggccctggccaagcactggacagcggcgattgatatgttctgcacatgtgcaggcttgtctgccacgtgtcctgccctgtatactgccagcttgcaattcctttctgttctcttgaccgaagaagcaaaagggcatctccaggctaagagcaaaacacatttatgctgtagtccaacagtggcttcacttcttgatgactctcaggaaaatcagaaatctctagaacaacttagtgatgtaatccttcagtgctatgaagggaaatcctccaaagatatcctgaaaagagtagctgcaaatgcattgatgtcactgctggctgtcagtagaagagcacagaaacatgctttgaaagccaatcttatagacaattgcatggagcagatgaaacacataaatgcacaactgaacctagattctctgaggcctgggaaagcagcattgaaaaaaaaggaggatggtgttattaaagagttaagcattgccatgcagctcctaagaaactgtctttatcaaaatgaggaatgtaaagaagcagctcttgaagctcaccttgtccctgtcttgcactctctctggccttggattttgatggatgattcattgatgcaaatttctctgcagctcctttgtgtctatactgcaaattttccaaatggttgcagttctctttgttggtcaagttgtggacaacaccctgttcaagctacacatagaggagccgtgagcaactctctgatgctgtgtatcctaaagttggcttcccagatgccactggagaacaccacggttcagcagatggtttttatgcttctttcaaacctggccttgtcgcatgactgtaaaggagtaattcagaagagtaacttcttacagaacttcctctctctagcattgccaaaaggaggaaataaacatctaagtaatctgactattctttggttgaagttactcctgaatatatcatctggagaagatgggcaacaaatgattctgaggcttgatggctgtctagacttactaacagagatgagcaaatacaagcacaagagcagccctttattgcctcttcttatctttcataatgtttgcttcagtcctgcaaataaacccaagatcctggctaatgaaaaagtcattactgtgcttgctgcctgtctggaaagtgagaatcaaaatgctcagaggattggagcagctgccctttgggctctgatttacaattatcagaaggcaaaaacagctttgaaaagcccatcagtaaaaagaagagtggatgaagcatactccttagcaaagaaaactccttaattcttcctgagtgccatgggatgctacaccttgaagctgacagtcatcaacaggggagctaaagttgaagccagctgtgtgtagcagctgttacctgaagacgtgctacctctctacaaagtgttgatccccttctttcccatgagagagagaactggtgatactccaacaccgtccagttgtggcagctctccagaagtaatagcagctgacaactttctgtgccttttcctttctgttgaaaaggcatagaaagttctgggaacataaacatttttacccttttctatgccatttattttgtaaaaatcctatttaacagttatttaataaaacaatatttttagaaaaaaaaaaaaaaaaaaaaacaagaaaaaggggggggcataaaatatcctggaggggacaaattagcgtaccagttttgagaaggggccatgggggggaaaagcgggaggggtaaaggggctggaacgatcgggcttgaggccctcggggacatggaccacggaaacggaacatatgttgtgagttcgggatgggttatacagg

SEQ ID NO: 462331 - DNA, 1076 bp, Homo sapiens
cagggttccaccatgttttctgtgcacgagcaatctgcccaccttggcctcccaaagccaaagggaagctggcaggatctatctgatggagcgatttggcaactctggagtctatgggaggcctgctgctgccagggggaagcctggaagatacattgtaatcagtgccagttcccattagctctttgtttcccacccccaccctctctgtgcccccctcaggccagagtcacagcggtggaaaggcttctaaggagagcactctcacatctggacccagccaattggagagatgttgatgtgggcttatggccacagattgtaactattctgccttgccccctgcctgcaaagggcattgtgacacacctctgtgaacatcacaaaggtgatgtgactctcttccaaaatgggattgtggccaggtgcagtggctcatgcctgtaatcccagcactttgggaggctgagtcgaggggatcatctgaggtcaggagttcgaggccagcctggccaacatggtgaaatcccgtctctattaaaaatacaaaaattagccaggtgtggtggtgcacacttgtaatcccagctacttgggaggctgaggcaggagaatcacttgaacccttgaggcagaggttgcagtgagctgagatcacgccattgcactccagcctgggcaacgagagtgaaactctgtctcaaaaaacaaaaaacaaaaaaagctccaaaaaaccaaaatgagattgtgacatatcactggaccgagcaccttggtgatgtgactatcctctcttgcttgagtttcacatattattgttactgtgacatacctctgtgacaaacagctatgggaaagattgtggcatattactgaactaagcaacctagtgacgtgtctcttctgactggggcttgcccacagagacaactgtgacatagcactgagcccaggacccaggtgatgtgactctgctgcctgtttccaacattcatgagaggatggtaactatcccttgccaagaactcaggtgatttgactgtcctgccttgttgctgccctcagagaagattgtg

SEQ ID NO: 462332 - DNA, 601 bp, Homo sapiens
ccattgtgattattacacattgtatgcctacatcaaaatatcccatataccccataaatatatgtacctataaattaacttgtgaattcaacaacaaccatgagtcactcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccggcccttttgctcctctctctcccctccactttttttttttgtcagctccatgacaacatgaccagctcagcaaaggctgagactgcccatgacctgaaggctccaggtggctttaaagcgctatgtttaccaactatcccgg

SEQ ID NO: 462333 - DNA, 812 bp, Homo sapiens
gaaaccagctgctgaaagctggcggggtgggtctcagacttcaggtggcataataaaataagaaggaatgactcatgctgggacaccgatggcccgtgaaaacatcatgctaggtgaagggagccggagatgaaaggccacattcggatgtctgcctgagccccaccccgaatgccagcccttcttccctgagctcacccagccccagctccaggactgagagccccaggaagcttggagaggtgtgagagagacaggtgtccagcctcagccccgatccttcacctgcagagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggtgagacccagtcggcgcccagggtctgtcccggccggcgtctggaactacaactcccagcatgccccgtggccataggcttattgtctcgggggctggttcccgcccggccctcctgggacttgtatttttctctggccagtggccttggaccggctggattcctttgctctctgagtggggcactac

SEQ ID NO: 462334 - DNA, 1633 bp, Homo sapiens
tgagctccagaaagttctattttgggtcagagatctcaattataaattaatgacagctatgagctctctccctgggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacttctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctggtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtggagaaaaacctcaggaagaagtgttttgccgggggatttatgagcctgtgaaaagtagataattctttccatcactttacagagaacgcattggcaagtgcctgctggttatcccagcctgtgctaacacagtcaggactggacacaaaggtgatagggatggcacctgcaacagcctggtcactggcactctaaggccgggagagaaagcagggtcattgaggttatttggtgattatcacctgtggctctctgtgggcaaggtttggactgagagctgagaggggcttgggaacaaagtgaagacctggtctttaccctcaaggggaatgtgaccttgatggagaggcagcaggagaactgtacatttgagtacccacacagattcacacatgcacacacactctccctgatcggcagtcacaaagtcacagcaagacttcgcagagctcagcacctaacttctgattttcctgtagagaaaaggacagcaacaaggatagacagtttgtgctgaaatgccacctctcctctggccaagcctctcatt

SEQ ID NO: 462335 - DNA, 1837 bp, Homo sapiens
ccgcaaatcaccactcaacataaaatcacaactcctccgggggctgcggggagacggccccacccccttcccgcgggggcgggggcgcgggcgcgggcgcgggcggccgtactcggaggaatacggcggcggcggcggcggggctgggcggtttcccgccgcgggtgaatgagtccgactgcgctgccgccgccgccgccgcccgcatcgaagctccggccgcgtcccccgcgccagccccgggagcctgcgcgccgagacccctgcgtgtctgcgaacagacctccggcctcgggccatcaccccgggcagacgctgcagcccctgtccgggcctcttgcctgccgcccccatgagaaaaaccaacatgtggttcttggagcggcttcgggggtctggggaaaacggtgctgcccggggcgtggggagtgaggcgggggacaaggcctccaaggggcccctgtacagcaatgtgttgacgcccgacaagatccccgactttttcatcccccccaagctgccctcgggccccgcggagggcgagggacaggccgcgctgggcccctccacgtcggaacagaacctggcctctgcggccccccgccagaccccacggagcccccggctgcctgccaagctggcagccgagagcaagagcctgctgaaggcagccacccggcacgtgatccagatcgagagtgccgaggactggctgtccgaggaggccactgacgccgacccccaggcccagggtgccatgtccctgccctcggtgcccaaggcccagacgtcctacggcttcgccatgctggctgagagcccccacacgaggcgcaaggagtctctgttccacagtgagcacggggctctggcccaggtgggctccccaggggccgggcgccgccgggcagctgccaaggccaacgggggtgatgggggccccagggaggctggcggggccctcatgagccccggccgctacttcagtggcggggagagcgacacagggtcctcggccgagtcctcccccttcgggtcccctctgctgtcccgctccgtgtctctgctcaaaggtttcgcccaggacagccaggccaaggtgagccagctccggcactccgtgggccgccacggctccctgtctgcggacgacagcaccccggacgccagccccgggagccggcgccgcctgacccgccgggcacccccggaacctggccccgagtcgggccaggcgcgtggggagcacacggtccacgtgggccctcggggcagcgtgcggctgctggccgagtacgaggccggccaggcccgcctgcgggtgcacctgctggccgccgagggcctctacgaccgcctgtgcgacgcccgcagcatcaactgctgcgtgggcctgtgcctggtgccgggcaagctgcagaagcagcgcagcaccatcgtgaagaacagccgccgccccgtcttcaacgaggatttcttcttcgacggcctggggcccgccagcgtccggaaactggccctcaggatcaaggtggtgaacaagggcagcagcctcaagcgggacacgctgctcggggagaaggagctgcccctgacctccctgctccccttcctccccagccactcatcgctaggctgcacgggtgtgtgcgtgtgcgtgccaggtgagcgcctgcaggcactcgagtatagctgcctgtgtgctggcgtgtgcacgtgtaagcacaacgaatctactgtttgcacctccagcatccctggcgccacagagcgctcggccccagtgggtgctgtgcggtgaaggaggcaggcacacctgccagcagtctctcctttc

SEQ ID NO: 462336 - DNA, 446 bp, Homo sapiens
agcagttatacagactcaaaagagcgcaactagggttgccacacacgccaagtggaggagaagagcctgctgtgtgcgcgcacctgacagtcaccggcttctctttacgtttccaataggaagcgcacactacgctgtgggaacaaaaacaccaggtgtctgctatggccaaggcagataaggtctttctctccaacaggatccagagatgagccactggtactaacacccaacggctgatgaatacgtctgctgagggacacgttctacaaaacaatgaagtttgctgcatcaactgcattttcctttcatgaaaaatttctctgtaccatgcagtggtgtttgacagcatgttacccacagtagaattactttcaaaatctgagtcaatcttctcaaaccctgccgctgctttatcaactaagtatgcactactgtaaatcttt

SEQ ID NO: 462337 - DNA, 898 bp, Homo sapiens
cttcgtaacttccgtgttggttggaaataggttcattctttgttttgaaaaggagtcaagcgcagtggtgagaaggggaagaggagagcaggcggttccagtgcgacccaacggcagccagaggccgccctgccccgccgggccagaagcggactcggtgcagacatgcagctctctccgtggaatgtgcatgtgcacggagtagagacgggatttcaccatgttagccaagatggtctccatctcctgaccttagttaactaccacactcaaaagaggcaagtaagatcaaatttagtgaggagttcaggcagcgatggagactttggcactgagggccagagcgtgaagtctccctgccaggatctcattagtatacatgagaggtgcatatctcagggactacctgcagcggtgctcgctatccttgaccaagctggagaacaagagttgtctttacttgtgtttccttttagcgcaactagggttgccacacacgccaagtggaggagaagagcctgctgtgtgcgcgcacctgacagtcaccggcttctctttacgtttccaataggaagcgcacactacgctgtgggaacaaaaacaccaggtgtctgctatggccaaggcagataaggtctttctctccaacaggatccagagatgagccactggtactaacacccaacggctgatgaatacgtctgctgagggacacgttctacaaaacaatgaagtttgctgcatcaactgcattttcctttcatgaaaaatttctctgtaccatgcagtggtgtttgacagcatgttacccacagtagaattactttcaaaatctgagtcaatcttctcaaaccctgccgctgctttatcaactaagtatgcactactgtaaatcttt

SEQ ID NO: 462338 - DNA, 2119 bp, Homo sapiens
agtgggcagaggcaagaggctagcggctggaccacttgtgctggagtggtaaagaactatcatgaatccatttactgaaagtgtccatttctgaactcaccctaaagaggacaaacaccgcaaagtagttaaaagtcaggcattcgcgtcggacgtctgggtttgaattctgccctggcttgactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgccatctctgaggggttatgcagattctgagcaggtgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatct

SEQ ID NO: 462339 - DNA, 1508 bp, Homo sapiens
aaaagctcacttaacctgagacatggagactgtaatttgggagatgaagcctcgagcctaaggcgctctcaggtccattgtcaggggctcatgtcagaggagtgcgggcggactacagccctggcggccgggaggactcgcaaaggcgccggggaagagggactggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtgaatgacctatgctggcatgtccggtgtctctcctgcagtgtttgcagaacctccctaggaaggcacaccagctgttatattaaagacaaagacattttctgcaaacttgattatttcagaaggtatggaactcgctgctctcgatgtgggagacacatccattctactgactgggtccggagagccaaggggaatgtctatcacttggcatgctttgcctgcttttcctgcaaaaggcaactttccacaggagaggagtttgctttggtggaagagaaagtcctctgcagagtacattatgactgcatgctggataatttaaaaagagaagtagaaaatgggaatgggattagtgtggaaggtgccctcctcacagagcaagatgttaaccatccaaaaccagcaaaaagagctcggaccagctttacagcagatcagcttcaggttatgcaagcacaatttgctcaggacaacaacccagatgcacagacactccagaaattggcagaaaggacaggcttgagcagacgtgtgatacaggtgtggtttcagaattgtagagcacgccacaagaaacacgtcagtcctaatcactcatcctccaccccagtcacagcagtcccaccctccaggctgtctccacccatgttagaagaaatggcttattctgcctacgtgccccaagatggaacgatgttaactgcgctgcatagttatatggatgctcattcaccaacaactcttggactccagcccttgttaccccattcaatgacacaactgccaataagtcatacctaattcttttttcagggatagacttgattaaggatataaatttgtcatttattatgtataaaataccattgaaaagatattactgttaattttttatttaacacctaaagcatttccaacatcactttgctgcccaggtatgtatctatagttggcctgcaagacacttttattaattcttcattttttgtaaaacttatgtttacaagaagaaaacaaatcaaaacattttttgtattgtctggaaatagttcactctagtgtgtatctgttaatttatttgtcatcaaaagagcactttgcctaaaagaaaggactgacaagtgtgcaaaatgtttacaatcttttgtgaaattgtagtttatcattagtttgtatct

SEQ ID NO: 462340 - DNA, 3786 bp, Homo sapiens
ctccggcagcgcccagccccgccctccggccgctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacagaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacagggccaac

SEQ ID NO: 462341 - DNA, 3674 bp, Homo sapiens
ccaactatgaagactctcagggcgcgatttaagaagacagagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacagaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacagggccaac

SEQ ID NO: 462342 - DNA, 2909 bp, Homo sapiens
gctcagcctaactcccagaactggaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacagaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacagggccaac

SEQ ID NO: 462343 - DNA, 3755 bp, Homo sapiens
ctccggcagcgcccagccccgccctccggccgctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcagagacagggtctcactgtgttggcccagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacagaggcagcaggagtccccggaggccagctccctgcacatcctggagagacaggtgcaagagctacagcagttgctggtggagagacaagaggagaaggagagcctgggacgggaggtggagagtttgcagagccggctgtccctgctggagaacgagcgggagaatactagctatgacgtaaccaccctgcaggatgaggagggtgagctgcctgaccttccaggggccgaggtgctgctgtccagacaactcagtccgtcggcccaggaacacctggcctcgctgcaggaacaggtggctgtgctcaccagacagaaccaggaactgatggagaaggtccagatcctggagaactttgagaaggacgagacacagatggaagtggaagctttggcagaggtcatccctcttgccctctatgactctctccgggccgagtttgaccagctacgcaggcagcacgctgaggccctgcaggccctgaggcagcaggagacacgagaggtccccagagaagagggggcagcctgtggggagagtgaggttgctggagccacggccaccaaaaacgggccaacccacatggagctaaatggctcagtggctccagaaaccaaagttaacggagccgagaccatagatgaggaggctgcaggagatgaaaccatggaagccaggactatggaagctgaggccacgggagccgaggccacgggagctgaggccacaggagccaaggtcacagaaacaaaacccacaggggctgaggtcagagaaatggagaccacagaagaagaagcaaacatggaaactaagcccacaggagctcaggccacagacacagagaccacgggagtggaggccatgggggtggaggccacaaaaacaaaagcagaggaagcagaaatgcaggcctacggagtgggtgctgggcaagcagagcccccagtcacagggaccacaaacatggaggccacgggctctagggccacagggatggaatccacaggagtcagtgccacaggtgtggagaacccaggggtagaggccacggtcccggggatctctgctggccccatcctacatcctggtgccgcagaggcctcggaaaagcttcaagtagagctggagaccaggatccgtggcttggaggaggctctccggcagcgggagcgggaggcagctgcggagctggaggcggccctggggaagtgcgaggccgcggaggccgaggcaggccggctgcgagagcgtgtccgcgaggccgagggcagcggggccagcgggggcggtggcggtgacaccacacagctgcgggcggccctggagcaggcccgggaggacctccgagaccgggactcccgcctgcgggagctggaggcggcctcggcctgcctggatgaggctcgggccagccggctgctggcggaggaggaggcgcggggcctgcgggccgagctggcccagcgggaggaggcgcggctggagcagagccgggagctggaggttctgcgggagcagctggccacggccagggccacgggggagcagcagcgcacggcggccgcggaactgggccgggcacgggacgccgctgaggcccgagtggctgagctgcctgcggcctgcgaggaggcgcggcagggcctggccgagctgcgggaggcctccgaggccctccgccagtccgtggtgccggcctctgagcaccgccggctgcaggaggaggccctggagctgcggggccgggcagccagtctggagcaggaggtggtggccacgggcaaggaggccgcccggctgcgcgcggagctggagcgggagcgtgtgtgcagcgtggcgctctcggagcacgaacgcatcgtgggcaccctgcaggccaacgtggcccagctggaggggcagctggaggagctgggacggcggcatgagaagaccagcgcagaggtcttccaggtgcagcgtgaggccctgttcatgaagagtgagcgacacgcagccgaggcacagctggccacagcagagcagcagctacgggggctacggaccgaggcggaaagggctcgccaggcccagagccgggcccaggaggctctggacaaggccaaggagaaggacaagaagatcacagaactctccaaagaagtcttcaatcttaaggaagccttgaaggagcagccggccgccctcgccacccctgaggtggaggctctccgtgaccaggtgaaggatttacagcagcagctgcaggaagctgccagggaccactccagcgtggtggctttgtacagaagccacctcctatatgccattcagggccagatggatgaagatgtgcagcggattctcagccagattctgcagatgcagagactccaggctcagggccgctgagaaaggccaggcccagtggctacactgaccacacccacgcagggacctcacccccctgcaggccccttgcagaccggcttcacttggcttcacttggccctatccaggcccatgcacttggagaccagcctggttccctgcccgaccacccccagctggctccatcaccccacctggtctctgcacgcacacactggtcagtctggacccgggccgtgactgcccctcccccaccaccggagactgtgattccctgtgtcctccacatccagacgccagcccaggaataaaggcattctgtgcacagggccaac

SEQ ID NO: 462344 - DNA, 589 bp, Homo sapiens
ccaactatgaagactctcagggcgcgatttaagaagacagagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggtgagcatctcccctcccagccagtc

SEQ ID NO: 462345 - DNA, 1114 bp, Homo sapiens
aaagaaagatcatgtgggaatatttgactccgtacagtgtagtaattcctcttatgatggactcccctgaaaaattcatacagaacaagatcttcatccttgaagccatcattctcagtaaactaacacaggaacagaaaaccaaacacctcatgttccaaacaccacatgttcccactcgtaagtgggagttgaacaatgagaacacatggacacagggaggggaacatcacacactggggcctgtcaaggggtggaggaatattactagtgtaccatgttcatatatttcagacaccttcttagagacattgagattcctgacttggggttaccaatgccttgtggcctcagctgatagaatggacaaagtagaatgctcactctagaaatccatgggtggagtcgccagacctcatctggagttggtatctgggagagccaggagcgttattacgagctggtgtagaccagacaacctgaagactggttggagtggcagatgaaagcctgggaggcagcacgccatctggagctgtcgaaaaacacagatgaattagagcagagaaaactgtggagaacatatgctggatggaatcgaaatgctccatatactggaaaaactgttcctcaggatcaacaacaatgttaaacatggtccatttaatttaacattttcattcctgaactcctgtacttccttattgttcatttcaacacaattacattagtatttcagtcttaaaagccggcccccaaacagcaagacaaatgaatatgcagcacattcccacctgtacttctgtttatctaattgaaaacatggagggaatttagtgaagcaaatattaaagtacctttttcatttaactctttgttcaacagaccaaacaattgaacactgaagcagtccagatctcatattcttccccccgatatcatccattgctgccttaatcacaccactacatgtgaacacaatggctttcttttcctttctttttttttttggaggaagggaagttagctaaaattgtatttttctggaatgataaataaacatgaatggctgaatacagtgtattccagccttaatgctcacccatgaaaatat

SEQ ID NO: 462346 - DNA, 1275 bp, Homo sapiens
agcgggaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaaggtagctcccactcaaggccagagccatttacaatatgagtgttttattcatgagggatgcttgacaagatggtccagattactatgcattccaaccccaattcacatcaataaaaggtagagagttgcggatccaagatcagagctcatctctgcttcctgcctgcaactccatcttatccaaatctgaactccacctaattaacccctttcttccctggatggcttcccctgttgctcccataccttctgtctcagcctgtttctcgggatgaaccttccagagtcctttcagccattcctgcctccatactgtacccttccttccaaaccatctaggaaagtaaaggctcatatatttgagaagaagattcaaaaagtaaaatcccaagatgtggtatgtcaattccctactccatagtttcctggacataaatttaatagaagaaacatgaggcctcatttgcttctc

SEQ ID NO: 462347 - DNA, 1253 bp, Homo sapiens
agcgggaaccgaggtgggggcttggtgaaggcacaccaggaagagcaggctgcgcctcaccctccagtggagacagagggcagacattctctttggagcacacctcaggctaaatggcaaaaccccaatctcaagtgaacatcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaaggtagctcccactcaaggccagagccatttacaatatgagtgttttattcatgagggatgcttgacaagatggtccagattactatgcattccaaccccaattcacatcaataaaaggtagagagttgcggatccaagatcagagctcatctctgcttcctgcctgcaactccatcttatccaaatctgaactccacctaattaacccctttcttccctggatggcttcccctgttgctcccataccttctgtctcagcctgtttctcgggatgaaccttccagagtcctttcagccattcctgcctccatactgtacccttccttccaaaccatctaggaaagtaaaggctcatatatttgagaagaagattcaaaaagtaaaatcccaagatgtggtatgtcaattccctactccatagtttcctggacataaatttaatagaagaaacatgaggcctcatttgcttctc

SEQ ID NO: 462348 - DNA, 1200 bp, Homo sapiens
cagcagtagagtggtgataggaaagatggcatctgggatactgtgaatctctgagtctcacggtgcagccaatggtgtccacacaataccctccttaactgaaaaagcctggagggcaagaggttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaaggtagctcccactcaaggccagagccatttacaatatgagtgttttattcatgagggatgcttgacaagatggtccagattactatgcattccaaccccaattcacatcaataaaaggtagagagttgcggatccaagatcagagctcatctctgcttcctgcctgcaactccatcttatccaaatctgaactccacctaattaacccctttcttccctggatggcttcccctgttgctcccataccttctgtctcagcctgtttctcgggatgaaccttccagagtcctttcagccattcctgcctccatactgtacccttccttccaaaccatctaggaaagtaaaggctcatatatttgagaagaagattcaaaaagtaaaatcccaagatgtggtatgtcaattccctactccatagtttcctggacataaatttaatagaagaaacatgaggcctcatttgcttctc

SEQ ID NO: 462349 - DNA, 1234 bp, Homo sapiens
cagcatccgtttcacctgcagttgaagatccgtgaggtgcccagaagatcatgcagtcatcagtcccacggagcagcctgcgaggctgaggctcctcccactggaccgccccccaactggcaccactgctgcccctgcccctactctcagcctcacgtgactctcgggcagaagcagtggtggggcagccagggcagcgtcaagagtctgagccagctgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatccatggtctaggaactttgttacgttaacacagcaagtgagtgttgcagcctggatccaaaaatcaggcctggtcgacctcaaagtccagattattgacctttctaccataatgtatggagttctcataattttagccacagcccagttggctggaccaatggatggagagaatcactcagtggtatctgagtttttgtttctgggactcactcattcatgggagatccagctcctcctcctagtgttttcctctgtgctctatgtggcaagcattactggaaacatcctcattgtgttttctgtgaccactgaccctcacttacactcccccatgtactttctactggtcagtctctccttcattgacttaggagcctgctctgtcacttctcccaagatgatttatgacctgttcagaaagcgcaaagtcatctcctttggaggctgcatcgctcaaatcttcttcatccacgtcattggtggtgtggagatggtgctgctcatagccatggcctttgacagttatgtctactctagaccctgtttgcctgggtatcaccagcagaggctggagaacagccaagattgctgcctgtttcttcctctggaagttttgtcccagaggggcacccaccagatgccagccagagctctcctgtatgaggtgcctgttggcacctactgggaggtgtctcccagtcaggatacacgggggtcagggacccacttgaggaggcagtctgacccttatcagagctcgaatactgtgcagggagatctgctgctctcttcagagccatcaggcttttcaaagatgctttaagtctgctgaagctgtgcccacagcc

SEQ ID NO: 462350 - DNA, 2214 bp, Homo sapiens
ggccctcctctgccctcccaggccgcgccccgcgcccgggccccggcgatggtgacacatgcggcggcggcgcgccagcggcaggaccatggttgagcgcgccagcaagttcgtgctggtggtggcgggcccggtgtgcttcatgctcatcttgtaccagtacgcgggcccaggactgagcctgggcgcgcccggcggcggcgcgccgcccgacgacctggacctgttccccacgcccgacccccactacgagaagaagcactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcacatgtgtgatgggcgcacgcccacgcctgaggggctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaacagcacgcgggcgggcggcgtggaggtggatgaggacaccatccggcgcatcgaggagctcaacgacctggacatgcagctgtatgactacgccaaggacctcttccagcagcactaccagtacaagcggcagctggagcgcagggagcagcgcctgaggagccgcgaggagcgtctgctgcaccgggccaaggaggcgctgccgcgggaggacgccgacgagccgggccgcgtgcccaccgaggactacatgagccacatcattgagaagtggtagtggcggtggtggccacggggaggcctcttggggtgtgtgggggataaaacaggacagacgacaggtccacccaagactgtcaagggatgagcatcccaaacctgctccacagaggtagctgcgtcctgaaaaaaaacacagcagggacatagtggggctgggcagggatggggcttgagaaatcaacaggtgcagcccagtgggtcagaggaaagcgtgctcgaaggatgccatggtcagggcagagcctccagagcaggtgttgtgcctggagctgctctcctggcctccttggatttatcgcaaaaactgaaggtttgcgtgagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagctcctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggagggtttgggtagtaggcccgagctgcatttccggccttccgtgggccaactggcagcccaggagtggggaggctttggccaggcatgctgccacttgtgccgccgggctgaggtgtccagaggcggcggcagctggcagtgccctcagcccccaagtgtccagcctggcacttcccattcaggccacctgctttgggtcaacagttcctttg

SEQ ID NO: 462351 - DNA, 1462 bp, Homo sapiens
ttgtcacagtaggtacaggacatgggtctattagatcttagacactacagtccgtacatgccaatccattcccagaagacctcccctccccaccccagtgtcactgagccacttcctccagcacagccccacggagggaggcccttttgtgtcttgcccatcacctggctggccagatctgctcagctcttccctgactcaagaaaaacaagagagcttcattagtccgttttcatgctgctattaaaaactgcctgagactgggtaatttataaaggaaagaggtttaatgactcacagttcagcatggttagggaggcctcaggaaacttacaatcatggcagaaggcaaaggggaagcaagacacctccttcacaaggcagcaggaagaagtgcagagcccaagaggaagagcgccttataaaaccatcaggtctcgtgagaactcactcactatcacgagaacagcatggggaagctgccctcatgattcaattacctccacctggtctctcctgtgacacatggggatataaggattataattcaagatgagacttgggtggggacacaaatcctaaccatatcaagtgctctgtggtcccagataagccaagaaaccttcgtggaggaggccacccccacccttggcctccagacccagtgggatgcctaggaggaaactgaggcccaggagcctggagatgtgtctgctccaggtcacactgtgggctgtaggggtccggaacccagacatgtggactgcgccaggctctagccaatgactcctccaaaccactgcacctccccagccctccagagttctcatctgaaaaacggggcatcaggtctgaaggtcttcaatgccccttctggctgggatatcagagttttgggacctctctctccaggtcctcatgagtccagcaggagctctggcaggtccagggtcccctccttccctctgctgccactgctcagcacccaaccctttttaaaattagctctcaaaatacctcatcccggaacaagcgtgcaaaaggagacagggcaggattccaaaccagctgcaaggctccctctcggtgtccttccccacttcggcatgtctgtgcgtgcatgctggcttctgtgcatgcatgctggcttctgtgcatgggtttacatgaaactctgtatttattattcctaagataaagtttattgtatttattattcctaaatatttatacatttataatatttatatattatatattcacatatttgtaatatttatgttagttacattacatataatatttatattatatattacgtatgtataatatgtatattatatatttacatatttataatatgtatattatatatttacatatttatacaatttatatattatgtatttatatattgtatatttatatatttataatatgtaaatatttttatattatattt

SEQ ID NO: 462352 - DNA, 810 bp, Homo sapiens
ggccaacgctggttctatccctgcttgttgcttttttttttccctccgcttcttgcgacggagactgctgtccaggaagtgcgcagtagtgattctagagaggctggaagctctcctggcgacgctggggccgcgaagggctcacgtaatgactcctactcctggtgagcgcaggcgttgcggaactcaccgtcccacaggacgtgtttccgggggtacattaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtggtaaatcagactgtgaagtgcttgaagttttctacat

SEQ ID NO: 462353 - DNA, 1211 bp, Homo sapiens
ggccaacgctggttctatccctgcttgttgcttttttttttccctccgcttcttgcgacggagactgctgtccaggaagtgcgcagtagtgattctagagaggctggaagctctcctggcgacgctggggccgcgaagggctcacgtaatgactcctactcctggtgagcgcaggcgttgcggaactcaccgtcccacaggacgtgtttccgggggtacattaattgtggctggacgcagtggcgcggcagtttaattctccggcggctgcagattgacgggacgagatggtcctggcagggctcatcaggaaactcggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactgaattgtcaaaaaaccctgaaatcttaacaggatattttccccaagacaaaagtaatttccagcagatggaagtgccgccacgaccagtgggtgtgtatatgtcgggaagtaaatcctgttgacttgggaagttgaaaattaatgtacttttttcgttattgtgaagatgtatttttaccaaacttgaatgtttcagcaccaaactatcattaaatgttttagttgtttcaagttagtttaggatatcgagtagaaatgataaaattttgtgttattctaaccatatttgaacaactgtgtagatggatggtattaatggcagtagtacctcatctaagaggaatcatacagtatttgtccttttgtgtctggtttatttgtaatgttttcaagcttcatccacattgtagcttgtatcagaacttcattcctttatatggctgaataatattcctttgcatgtatatcccacattttattcatctatgcatttgtcgatggacatgtgggttgtacccacatttggc

SEQ ID NO: 462354 - DNA, 1031 bp, Homo sapiens
aactcaggggcggagtttcatgatcccggaaccggtggtagtgtttgggtttgaggagagcacgacccagccctctggggtggggtctagcggcgtcagcgaccaatcgcgccgaggtctagtggggcggggctccccgggggcggggcctgtgccagttccgggccgcctgggggcgtggccgggcctgtacagcagcctgggccatgtcggcgccgccggccctgcagatccgggaggcaaacgcacacctggcagccgtgcaccggcgcgcagcggagctggaggcgcggctggacgcggcggagcgcacggtgcacgcccaagccgagcgcctggccctccacgaccagcagctgcgcgccgccctagacgaactgggtcgcgccaaggaccgtgagattgccacactccaggagcagctgatgacctcagaagccactgtccacagcctgcaggccaccgtgcaccagagggacgagctcattaggcagttgcagccccgggctgagctgctgcaggacatctgccgccgccggccacccctggctgggctgctggatgccctggctgaggctgagcgcctggggcccctgccggccagtgaccccggccacccaccccccggtgggcctggtccaccccttgacaacagcactggggaagaggcggacagggaccacctccagcctgcagtgtttgggaccacagtgtgagcccggaatgcagattacagaatggagacagaaagccactgctgtcagtgtccttgggagtcaccagcaccctgcagggggaccctacggcagagccaaagtcctgtctaagcatcagaacaggctgaacagtcaaaaagttttcaaataggcccacaggccaggtgcagacgtttaacccagacagaagtgttcttgtttgtttttaagctttgaatcagtcacccttgctaaaaacctggcaatgcaaacacaaagatctggatttctggcaagacttggccaagcttgcctggagttcagggcaccctcttt

SEQ ID NO: 462355 - DNA, 891 bp, Homo sapiens
tttctgcttatcaatgactcttgaagttgcaggaattccaggactgtgcggcatttttattggaaaaagacagatattttttaagttgagaaacacttgctcaatgtgcttttcaaatagagaagagaattgcagaaggaaggtaacaaacacccttacagagaaggtgaccttccagccagatcttgaagtcaagggagcaaagactttgaagaggaggagccaagatggccaaataggaacagctccggtctacggctcccagcgtgagagatgcaaaagacgggtgatttctgcatttccatcagagtttcaagtaaaaatgaaaatctcaaccgtgtcattattcatgccaagccttaaacctggatcaagcttttctatctaatgtcactcatcaaagacaattgtaaatccttcatctaccttatcttatctaatactcacaaaaacaaagggtgatatggcagagacagttacagtgctcaccaatgactgcaaaatgtccgcatctcccagcctcacttgcagatagatggggaccatggaactagttcccaccaaagaactatgagtagaaatagcatgtgtctggagccaaagaagttaaaagctgacatgcctcctccatccctcttttctcctgcaataattatcttggcttggaagccacaagagaagatgagctgacagatccacactggaatctacaagagtgaaaaatataatttcattgtgttaaaccactaagatttcagaatttgtctgttataacagcatagcctatcctgtcctgacaaacatagataatatttggaatatgtaataactagtacagaacaggcactaacatattagaatgaatgcaatgaccaatgaatgaacgtcatc

SEQ ID NO: 462356 - DNA, 1876 bp, Homo sapiens
caggttttttgatttgtaggctttatttcccagcactccaaaagtgttcaatgtactaaatctataagcttgctttgaaagaccagcccatgtcttttgattgttgaatgacattcctttgtatggatgtaccacagcctgttttgtgaccgctggtttgctatttgttttaggataggaccatgagactgtggaatattgaagaaattgatgaaattcctttggtaatcaagtacaaaaaggccgtgggcttaaagttgaaacagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttggaaaacaagcgtgcatgtgcatctgaaaagcagtcttgctatttctaagctttatgtcttggtgctcatcctgtttgattcttggaacacatattagactcacattgtggagtctggagttgccctgtaaggtgacctgtgggggctggcaccagcagttctggagagtttgtcaaatgagtatgacaaggtgtggggccccctctgctgaggtcgcggggcagaatggtccgaagctcaccggggtcacagtcggaccgaggcgggtgtgcgcctcgaccggacgccaggggagccagcagcccggccgcgctggcggggccgggggttctccggagtgggtaggggctcgaccgcactgccctgagtcccaagccctgcaccagcgttccccaaaggcggagcgtcctggctccacctgcctgtgtgaatcggaagctacactacgcgtgcgccacaacaggccgaatgcggcgcggggacccaggcgaccgcggttgccatggtgctggctggccgtgggaggcgagcggcgggctgggaagcagctgtgcgagtccagcgaggagccggtgttcgccccgaggctgcttcctcagggcgggcggtggacgcgctctcccacgccgccttctgtggcgtgggttcctcgcgctagtcttcctggctccaagctgccacttgggggagcccacgcgggtgccgatcctcgacggggccctggagacctgggggtccatcagtatgtccatgtgctggagcggctgctggcaggatcaagaacttccctccaaacgctctctggcttgactattcgcctgatggaacaggcagaaggatagaaattagctctggggggagcggaaacattctgaggccagagcaagctggtgatgagtggggcttggagaaggtggcaggcagggctgttcacaggatcatgcagcttgagctaaaaactttgaagtctgttctggagcattttcagcagtggggatgaaccaatttgcatgttaaaaacgtgagcaatgaattgagaggcaagggaccacatggagggaggcctctgtggaggtccaggagacaggagatggtggctgggaccagggaggtggtcacggtgatggagaaaggaagcccctgctctcatgtctgagccctctgccccaccactgctccctcacctgccccagccagtcagttcccatatt

SEQ ID NO: 462357 - DNA, 3572 bp, Homo sapiens
cacaccttgctccagctgtggggagggggcagctgtctaagcagctgaggatctgaggattgctcttgtgtggcagagaaagagcctaatccactatgttttaggggcatctggccaggctctggcccaggactggagaagctgtgggaagtaggtccgcaggtctgcccaggagccaaatgaaagcaggggtcaggggaaggagcagcggaaggtggtgaaagggcaggggaatgctgcctatcctccaggcacctgtcccctccgcccgccctaggcctgagtccttgttagagacttgttgcccaaagctcttcctctgcctggtgaaaagcccactggggtctttggccccggtcggcctcccctctcctgtctcagagcctcttggctgcagagagcagaagttgggtgtggggttggggggtgctcgggcacagctgctgtgccaccctctggcaacaagtggctgacaggggtgcacccaggtggtggtgagggctcgccaagcctggagcgagagcccaccgttaactgcctacaatgaccatgttaattgggtatacggagaagccacctacagttcccaacgaggagctcagcagaaccaacatcttccttccccaaccttgtccccgagtgggcgcctgggcctacaagttcctgcagactccagggcctccagatgctgggcagctggttaccaacaacgacaaacatcaagtaccctggatccagactgcccgatgcctagaagcctattccatgtgtggtgagtgggagccgtctgtgttcttgagggcttcagcggcagaggggagaccgtccaaggagggcttcagcggcagaggggagaccgtccaaggagggcttcagcggcagaggggagaccgtccaaggagggcttcagcggcagaggggagaccgtccaaggagggcttcagcggcagaggggagaccatccaagggagacttaatcatacagccttccctcactgccagggggtctgggatcttcagctgggatttaacctgggcagccaggtgctcagtgcctgggtcctgtttgcggctgcttgttcgcattccagcttcccttgtgcccgcagtcaggctctacacgtgcgccagcctccgagcgcacgtccccgagtgacccgggcgcttcacgcgcgccctctccggcccgcgggcggccagggacccgcgctgggctccacgcttcccgtggggctgacccctccctcgcgccccgcagcgggccgcagcgattggccgccggcccccttccagccgtcacccctccctccctccgccacccgcgcgcccgcggtccccgctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagagctcagtgaatggtcaactcgctgctgtgtgcgctgtgacccttctgcctccgcatttagctgtattgtgacaccctcttaaccatttcctgtctccatctgaggaaggcattgctatttaagcggcagtatcccctatctcaggccagcctagccatgggggtgagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccacaggaaattcaagggctgaggggtgagttggtctgtgggtaaaatttcgcagaatgtgataagagttcatgaccttccgatagaggatactaatgcttaactcaacaaggtcctaaaccacaatcttcttgtaaaactattagagagtttgccagcttaaatctgttctttttagtttccattgtagtagtgtaggatgtaggccatttcagaatagatgtagagaaataaccatttttgtatcttcatcttgtttagccgagtacattgcactgtaaatccctgttaagtggattccttttgccttggcttagaggctgcagcacttcatttttcagttatctgggtgactatcagttagcttcttggcagcacccaggcataactgaagattgcacttagttggaggcaaaaaatgttaaacatatgtattaaaaaaatctttgatgaaatgacagttgctgctatcccatagcctctgaaaacttggtgcaccaaggtccctggcttaagtgggagccatggccatagcgtcttaattgtttaattgtacaatgtcaagagcatctttggacatccgccctggccctcagagctgcccctttaacagccggctcccttctgctgctcgccagccagacctgcttgaaaactgaaacaaaacagcagcaataataaaagaataaggcccctactttgagggcccttccaaaataaagtcccaaatagcctccccagactgccatttggcaatctgaaaagaaagagaaaaaagaaaagaaaagaaaaaagaatcccagcaaaatggttttccattaaacaggggtagcgtgttctgctgtgctgaattacttcctgttcttattttgtgggtaattttttctgtatcaaatatccttttggttgtgtatctttttcaccttttcttgtactaaaactaaagcatgatctgtatttttttacatcccccagttgacaatgtacagcgctcggttagagatgttaccctgctgaaacgtactgtggtcgtgtagcccgggccatctgctcattgtacgctgcttttgttctgttgcccttccgaagcatggtgggcccagcctttttttttgtatcgtgtgcatgacgacattgttacacacagaatccactaatactaatatacaatctctcaataaagaactagttttcctatattaacctagtgtgctttttctcttgctgttttcccatttattgtcgtatcctgctgtttagattttccccccttgcttttctatccccaccctcacccacccacca

SEQ ID NO: 462358 - DNA, 2076 bp, Homo sapiens
cctggattagactgaggtggtgccagcaccaggggtggggccgtagctggggcggagcctgataacggaggagggtctccagccccagtgcccaaggcactatgactgtgagatctgagctacttattgtccccgcagtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgactggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaacatatcccttcccagagggggctggggctggggaggggcgcaggccagtgttgggggaggcgggggcatggcccaagtgtggtcagttgggcaggcttctcttggcctgcttactgctgatgggctgcattctggcagaataagctgaagccagcttgggtgcacaccctgtcaaaagcagagactcctagaaggtaaacaagaaaatgaggcagaagccaggatctagggactggacacacaccagagtcctggacatgctctgaagaacatggagcccatggatgccccatttctcaggctcatggtgacgtgcctgaccccagtacccactcagaggtggggctgggccccagacagttcccctggctcagccaggactaggtggggaacccagcaggtctaaatctgcaactgagcagggctgggcactcgtggctcacagtaactggctgtgttttttggaaagcaccattctgaggacagtggatggataagttctgacagaggggagaatgcacgctgtagtggggtgttgcaggggcctgagtgcagggccacagccatccctgccctgctctggccaacctgcacctctccttaactctgagtccactggaagctgtgaagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagctacatcagtacaacagcacaaatacacaagcgcgacttaactggggcacagccaccctcgcccccatgacctgactccacctcctacacagttcaccaaaccctttctctctgtccgtccctggggcaggagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcggacgccatggcctgggagctggc

SEQ ID NO: 462359 - DNA, 1526 bp, Homo sapiens
cctgggaggcaggcagactgggccaacctcgcccagcctgagagtggcctctgtgcaggaagcttccagttttctggagtacccaggccaggggtttaggacagagtcctctcatccctgcaggactgggtgccgtgggccacattgccagaatgccacattgccagactgaatcagaggctgcagtgagaggctcccagaggtccctcctggggagtggggaatgggctctctggaacgcccacgggctctcagaagagggctccaggggctcagagtgcgggggagttgcgggcatcctcaggggtgcagtggggagaggccacaggaccacagctgcttttcacttgggtatattatgcgatgctgaggtttaggggatggttgattgcatcacccaggtggtgaacaagattcccgatgagtagtttttcagcccttgcctcccaccctctcctgcccctagtagttcctaatgtgacctgcaatgtattccattcagtcagcaccgactgggcaaatcacctaccaggtgtttctgggctcgtccccaaacttccatgggtgaagaaacttggaacaatagcagatgctccccagctggcatgctctgttctcttgggttccatcgtcccctggctggcatttcagaatctcccaatgttagatgaccgaagatgggatatggccagatcctgtcctgggattcaaatggttctgtcagggacaatgctggtgttgaccacctcctggaatactgcaggattctttcagagcaacagccaaatgaagacagccgtgggatcaagccttctgtactaattgtgatgtcactgggaagtgggcttcccctgtggacactggattgctattggacctgagttttcaaggttctggccaacctgggcagctaaggaagctccctgacacagcaaaccatggctgcagtacacaagtgtgctacagcccaatcctggacatatggtcgttaccaaaaccccagtcatcttcttgaaggagccttagtataggaaaccagagagtcaagacccaggtaagctggcccgtgaggcgtggttcccatcgccaggagacaacagccgcgctgaccagctgctggcaatttcttcggtcaccctgcctctcaacttccaaagccccatggttttcgggtttacccacatatgacccttatgtaaatttgcttgtcccaagaacccttaactcatatcgtgtctgtttcctgtgtggttggttattgatatagtttggataaaatgccttggtctttagtatagtttggatattgtcctctccaaatctcatgttaaaataaatgtgacctccaatgttggaggtgaggcctggtaggaggcatttggattattggggcagatccctcatgaatggcttggtgccctcctcgtggtcatgagtgacttctcgctctattagttcaggagtttaaaggagactggcacctccttctccctctctcgtcacatgatgtgcctgctccccctcca

SEQ ID NO: 462360 - DNA, 4033 bp, Homo sapiens
gtcggccctgtccccgcagcctggccggagaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgcttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacgtgaggccagggcacacaagagggggaggaggggaggagctgggcgggtccctcagcgcccggcagagccgacacccctttccccagattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagagtgaggatgcacctgggtgtccctcagagcgggtcacactcatggtggggcagggtacacgggagacgatagaaatcagggatgctccctgggacccccatccagctgaggctcctgagctcttgatttgcagccacctagcatgacagttgcttttctctcgaggcagctcgggcctggggctctgcctgaacaaccggccccccagacaggactttgtgtacccgacagtggcaccgggccaagcctacgatgcagatgagcaatgccgctttcagcatggaggaggaagggaggggggcgagcctgagcgggcacctcggcccgcaggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgaggtcagccgcccccttccttcgcgcccactgggatgcccaggtggggtgtccacggagacgcctctgcgcggtctccaggttagctgtcccctcctcacttcgcactggggcagcaccctgagcacgaaacgccccttccaactgcagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaaggcacctgacccttctgtgcacccaaacttgtgacatttccccagtcactttcataacctgtacctattcatctccacctgtagcacaatttcctgaatatttttcctttaaatcggtttttcaacctcaggcactagtgacattttgagctagatgattgcc

SEQ ID NO: 462361 - DNA, 337 bp, Homo sapiens
cctccagcagtctaagaactgatgcctctaacgaaggaaaggactgcatgtttctgatgaagctaccatgacctaccagatttccaacgcctgccaaaattaatctatttgtctgtggtagaagaggccataccattgtggcccttgaaacttactgtatgatgttttatttagcgaacagttcacatacccaaatggttgtaactgatactgctgaatatattgtaagaacacaagtgttaagtatgtatcctgctttttttgactgtacagtcactgttcagcgaagccctacatcaataaagttctgtcttgtgtagatttctacgaaatgcgg

SEQ ID NO: 462362 - DNA, 4217 bp, Homo sapiens
cgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgcttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccagggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacgaaatgcgg

SEQ ID NO: 462363 - DNA, 4320 bp, Homo sapiens
cgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgcttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacgtgaggccagggcacacaagagggggaggaggggaggagctgggcgggtccctcagcgcccggcagagccgacacccctttccccagattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagagtgaggatgcacctgggtgtccctcagagcgggtcacactcatggtggggcagggtacacgggagacgatagaaatcagggatgctccctgggacccccatccagctgaggctcctgagctcttgatttgcagccacctagcatgacagttgcttttctctcgaggcagctcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagggggcgcgcggcacccggagccacagctggcggggtctccgccgccagccctgcagcgggccggccagagggggccccgggggggcgggaactgggagggaagggtgagacggagccggaagttatttattgggaacccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacgaaatgcgg

SEQ ID NO: 462364 - DNA, 462 bp, Homo sapiens
gcccaacccccggggacggccctgaagtgggtgaccagccagggtgcgccaggagggtcctggccagaggcagccacagagggcattgggggtcctgacttcatcctagaacttctggaacctcggaaatgcattgctgtgtctctgccaggccatccttcaccatcccctccctgcaagcatttattaagtgccactgtatgctgagtgtttcaggcacctgacccttctgtgcacccaaacttgtgacatttccccagtcactttcataacctgtacctattcatctccacctgtagcacaatttcctgaatatttttcctttaaatcggtttttcaacctcaggcactagtgacattttgagctagatgattgccgtggggagctgtccagcacattgtagggttttttgtttgtttgtttttcttttttggagagatggggtcttgctgtgttactca

SEQ ID NO: 462365 - DNA, 450 bp, Homo sapiens
gaggtcaggttgccaaacttttccaggactcgagtctgggaagcaccgttaacatcctcgtaactcgcctcatcctgctcacggaggaccaggtgcgggggacttcctccccttccccttccccttcataccagcatgtcctgccgtcccctgggtggtgggtgcccatgcatttccctctgtccatccccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacggtgaggggacaggagaggtctaggactggggctgagaaaacagatggtccagggaaccatgagagtccaaacagagatcacttctgctagggtcaggaggagcagagaagt

SEQ ID NO: 462366 - DNA, 720 bp, Homo sapiens
tcagaccccgcctctgcccatcccggagaggctgatatctctggctggggcctggagtggggaacggtgcatggggccgacgagtgtcctccgggctggactcactccttcctgtctccccccacccagtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccggtgagagtctccagcttccc

SEQ ID NO: 462367 - DNA, 3606 bp, Homo sapiens
aggctgaagcagtagaatcatttgaacctgggaagtggaggttacagtgagctgagattgcaccgcagcactgcagcctgggcaacagagcgagactccatctcaaaaaacaacaacaacaaatagtaacaacagcaaatattacctattcatgaaaagactgatacatggctgggcatggtggctcacacctgtaatcccagccctatgggaggccaggcaggaggatcacttgaggtcaggagttcaagaccagcctgagcaacataccaagacccccatctttaacaacaacagcaacaaaaaaccctaatagcaggtttagcctaagacccgacacacagtaggtgcctgatgaaagcaagctgttatcattgtttttgcttttcattttctaccctgggctcctcttaagactcggtctctcttgtttcttggaggtcaggttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccagggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacgaaatgcgg

SEQ ID NO: 462368 - DNA, 4407 bp, Homo sapiens
cgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgcttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtggcctcgcccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccaggcccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctggacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctggccacagcgttcaccattgcccacgagatcgggcacacgtgaggccagggcacacaagagggggaggaggggaggagctgggcgggtccctcagcgcccggcagagccgacacccctttccccagattcggcatgaaccatgacggcgtgggaaacagctgtggggcccgtggtcaggacccagccaagctcatggctgcccacattaccatgaagaccaacccattcgtgtggtcatcctgcagccgtgactacatcaccagctttctagagtgaggatgcacctgggtgtccctcagagcgggtcacactcatggtggggcagggtacacgggagacgatagaaatcagggatgctccctgggacccccatccagctgaggctcctgagctcttgatttgcagccacctagcatgacagttgcttttctctcgaggcagctcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagccgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagccgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccagggccactagggggcgcgcggcacccggagccacagctggcggggtctccgccgccagccctgcagcgggccggccagagggggccccgggggggcgggaactgggagggaagggtgagacggagccggaagttatttattgggaacccctgcagggccctggctggggggatggagaggggctggctatccccccagagcccctcttcagcatccgccccttccagttcacatagtgagaccccccctccagggtgggtctggggaggggacagctgttcaccccagcaccctttgaacccacccttagggagtccccaacactccccccctcctttgatcggaatatgtactgtgaagagtaggggtggggaggtggtctgccggtgccctgccccccagcactgccctacccctccactccgagctgggggggaatctgtgtctgctatgggaggggggggggtagcaccacctccctgacaccctcccctgacctgactagggggaggatccaccccaacctctgccctgcccgccccaggggcaccccgacatccaggccaccccctcatggtgctacagaccctgccctggggcccacacactcctgccaggaagccctacatcaataaagttctgtcttgtgtagatttctacgaaatgcgg

SEQ ID NO: 462369 - DNA, 208 bp, Homo sapiens
cggtgtggggagagccggcacgcccttggcttagagcgtgtgaaatcaattttggggttgggaaaaagtggaaggcataagcatagaaatattttaggatattttaggatatgtgaataaagctagactcaaaccatcataataaacatttttttttttttttttttttttttttttttttttttttttttttttttttttttttttt

SEQ ID NO: 462370 - DNA, 3296 bp, Homo sapiens
  misc_feature (1796)..(1796): n is a, c, g, or t
  misc_feature (2225)..(2225): n is a, c, g, or t
gcaatccaccgacctggagttcacggcctccgccctcctggcccagcggcccccacccgaccccacccgaccccacccgacccaggccggttccggtcacgccggaagcacgtggccccccaccctgcggcgttgcccgggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagaggattctagtctggtaaataaccacagtgtaggaactatctaactggcatttgtgtttcttgcgagtattttgaagaaacaggccgttgaccccatctttggaagtagccctttaccatgcatggtcagtttcttagggatttactatttgtgtgaggtggcatctaagggaagaatgggttttcttccccaaaacatcagcatttctaaaatagtcctaaagcttgaaagtaagttgcttccatgagcatggattacccagtagctactttttaatagagactgactaggtttacaacttctgggagctactctgngggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccnatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccagacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccatcataataaacattttttttttggacaaaagatgatacgataaaaaccaacttgtgtgaaactgagtcagtggagaagtgcatctcgtattttaacctaaggcttcagctcccacacacgactggacagaggggtgtgttagcctgatcttcagttttctcattgggaaagcacttgttccactgt

SEQ ID NO: 462371 - DNA, 1480 bp, Homo sapiens
gcaatccaccgacctggagttcacggcctccgccctcctggcccagcggcccccacccgaccccacccgaccccacccgacccaggccggttccggtcacgccggaagcacgtggccccccaccctgcggcgttgcccgggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagag

SEQ ID NO: 462372 - DNA, 1459 bp, Homo sapiens
ctcccgcggccctaaggtgctggcgggcgtttggcgttgcagctgtgtgggcgctggtgcgtgcgagtagcgctcgaagaaacccaaaggcgtcgtggggctgccgtgtgccccagagagcactgcaggccgggtaggggctaaggctccccgcagtcttctgtgtgtcgtccagtacgcagttgaaatcgttctccaacctggccagtcctccgaggcccttctcaggcgaccagactctgttaacagagtccattgctaaaactcctcgttagtatttaccactcctccagtctgtgttttgaagcagtggttttcaaccactgcccgttttcagaagaaatcatctcaagcgtccgtgtgctgctagaagccgggccgggaggtcttggtgccggactccaccctgcagcccttccctttcgccaccgccctgtgcttagagaaaccttagagtggagcaatgagtcgcccttgactgagtaactcttcggggtcaacttctccttccacgccaaggaaaggattccagggcgatgtttctggaaatagagatctgaccaagccactgctctggtgaaaattcagtgggtccctagcacctagtgcagcggctcctagcctgagtattgccgtctttcggtggggaggggttgggtttttttgtagcatctgttgatctgatctccaacatcctccacgtcaattcccactccacccacatcccttatcctatacgtaagctttccagccacggtgctggcttgggtgggggtgcgtgcggtgctgacaccaaaatggaggtcccgtgtttctgagagtctctttcagagcaatgcaaacctgaaactactcctgccaagaaacgattgcagctcttcccggaaaagttaaagcctttgagaaacaaagctgaggttgaaagtattagtccattttatagatgaagaaatggaggcccagagagatcacgtgacttagccaagtccaccaactaatattgggaagctcagcagggtcctgggggcccacaggaatgtgaataaacacgcttggaaagtctgcagaatttccagtcctagcctcctgctggtgtgaacctgggctcctgtgcctgggaccctgggagggcctaggggatgccaaattccagggtccagaaagagcttgggataaaatgaacatccaaggggagggctttgacctgggctgagtctgcctgtgccgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcatatccaggagctctgcatctgtagattcagcaacagcagatggaaaatattcagaaaataaattggacagttatatttctattga

SEQ ID NO: 462373 - DNA, 2294 bp, Homo sapiens
ctcccgcggccctaaggtgctggcgggcgtttggcgttgcagctgtgtgggcgctggtgcgtgcgagtagcgctcgaagaaacccaaaggcgtcgtggggctgccgtgtgccccagagagcactgcaggccgggtaggggctaaggctccccgcagtcttctgtgtgtcgtccagtacgcagttgaaatcgttctccaacctggccagtcctccgaggcccttctcaggcgaccagactctgttaacagagtccattgctaaaactcctcgttagtatttaccactcctccagtctgtgttttgaagcagtggttttcaaccactgcccgttttcagaagaaatcatctcaagcgtccgtgtgctgctagaagccgggccgggaggtcttggtgccggactccaccctgcagcccttccctttcgccaccgccctgtgcttagagaaaccttagagtggagcaatgagtcgcccttgactgagtaactcttcggggtcaacttctccttccacgccaaggaaaggattccagggcgatgtttctggaaatagagatctgaccaagccactgctctggtgaaaattcagtgggtccctagcacctagtgcagcggctcctagcctgagtattgccgtctttcggtggggaggggttgggtttttttgtagcatctgttgatctgatctccaacatcctccacgtcaattcccactccacccacatcccttatcctatacgtaagctttccagccacggtgctggcttgggtgggggtgcgtgcggtgctgacaccaaaatggaggtcccgtgtttctgagagtctctttcagagcaatgcaaacctgaaactactcctgccaagaaacgattgcagctcttcccggaaaagttaaagcctttgagaaacaaagctgaggttgaaagtattagtccattttatagatgaagaaatggaggcccagagagatcacgtgacttagccaagtccaccaagtgagtagacggagatgacctgacctctggagttctgtctctaacataccctagttctttcttgattgtccataatatacaaacacagtggcctgagaatatttactcccctggtcactatttcttcagctggaaagggaaacaaattagtaacatttgaaaaaacaaaaaccccaacaactaaaaaagtattactaaatgcaatgctgtttgagagaacaaactgtcaacaaaaataatacttaattctctggaagtgaaattaattaaaaattcagaggagataccagaacactagctggtaggattaaataagtgaaggaccagctggagcaacatagcaagacctcatctcctcaaaaacaaaaaagaaaagaaaattaggcgtggtggcatgtacctgtagtcctacttacttgggaggctgagtgtcaagggttggggggagagaggaggatttggaagtaatgactcaggggggtggggtttcttcttggggtgaaatgttggggatggaaatgttctgaatttagcatgctggaccacatcaagttcagaagcttctgaacagcgaaggaaacaatcaatgaagagacccacagaatgagagaaaatatttgcaaaccactcatctgaagctcagataactccataggaaaaaaatcgaataatccgatttaaaaatgggcaaaatatctgaatagacatttctcaaaagaagacacatattctacattgaaaaaaaaaaataaggccgggcgcggtggctcatgcctgtaatcccagcactttgggagactgaggagggcagatcacctgaggattgtgttactcattgtagaaaaaccagtaaccccagcaagcaagctcacccccctggctccacagacctccccagtctcatctctcaagactcctgcccttcacaagatgctctggcgcaccccagccctgtgctccctctcatttggtttcctctgcttggattgcccttctcaccttctttagttggtgtctgctcaccttctaagactcagcccagtccttatctcctccaggaagccttccccaatctcccttccactggctgggttaggtgctgtcccttgggctcctatcaacctgcccctgaaccagaccctttatacagcgtcacctcattgaatctgacaaagtataactcagctcctagttcaaagtaaacatctgccctgccattgatcccgctgaggtaacagaaataaagccagctgtggaggtgtcttctgctttggcctcagcagatcccaagatggaagcc

SEQ ID NO: 462374 - DNA, 488 bp, Homo sapiens
atctctttttcgtttctgatattttaactgggtatttctctccatgacccttggatattctagctagaggatcctgtggggaaagtgccgggcacacagtaggggctcactcttctagacgtgttatctaaaacctggttcatctgtccttccacgcagggcctaggggatgccaaattccagggtccagaaagagcttgggataaaatgaacatccaaggggagggctttgacctgggctgagtctgcctgtgccgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcatatccaggagctctgcatctgtagattcagcaacagcagatggaaaatattcagaaaataaattggacagttatatttctattg

SEQ ID NO: 462375 - DNA, 1464 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcatccttccatccccaggcactgaccctggttttcacttaggtggctccaggtggcctgtgatccttccccacagcaatacggcattcacattctgattcccttactggacgtcgggcccttcttctctcct

SEQ ID NO: 462376 - DNA, 442 bp, Homo sapiens
aaatactcatgtgtatgggcaaaacatgtcttctttgtagcagctaggccctgccaccactgtgcttggctgagttcacaaatctgttgtaacctgtagcttccctgtcacttctctggctctcctctcctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaaaaaaaaaaaaaaaaaaaaaaaaaaaaaaaaaaaaaaaaaaaaaaaaaaaaaaaaagaaaaaaaaaaaaaaaaagacaaaaaaa

SEQ ID NO: 462377 - DNA, 1445 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaaaaaaaaaaaaaaaaaaaaaaaaaaaaaaaaaaaaaaaaaaaaaaaaaaaaaaaaagaaaaaaaaaaaaaaaaagacaaaaaaa

SEQ ID NO: 462378 - DNA, 909 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtatgtatggtttatgtacatgtagttgtgacttctcaccatcttggctatgaagattgtacagtacgggagctgcattcagaatgtcacttgaagtccaagtccgagttggaacttgaaactttttcttacaggtgactttggtggcagccgtggtggtgatgctcaagc

SEQ ID NO: 462379 - DNA, 1360 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctttttttt

SEQ ID NO: 462380 - DNA, 1552 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagtactgttgtgacctgaagttc

SEQ ID NO: 462381 - DNA, 1443 bp, Homo sapiens
gcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagtactgttgtgacctgaagttc

SEQ ID NO: 462382 - DNA, 3129 bp, Homo sapiens
tcagaggctgcgagtgtcgctgctgaaggctgtggtggacccggccgggtcgcggattctgagctacatctcgggtttggggttagggttagtggaaaggccacgaggagccgcgggggctcaggagccggtggtgggcgtctgaggagaagtcgccccatgaggaagctcttcagcttcgggagacgcccgggccgggcggtcctgggctccatcgaccacgagtacccgggtcccgcgtaccacaccagggacgcggaactgcggaagatccacagggcggccctcaagggcgacgccgcggaggtggagcgccgcctggcgcgcaggtgccgggacgtggatgcccaggacaggactgttctacatttggcctgtgcccacggccgtgtgcaagtggtcactctcttgctgagcagaaaatgtcagatcgacatctgtgacagactaaacaggacgcctttaatgaaggctgtatattgccaggaagagacgtgttccattattctgctggaacatggcaccagtccaaacattaaggacgtctacagcaacactgctcttcatgatggtaaacattgaggatgtctacggcaacactgctcttcatgatgctgtctatgataaggggacttcactggcaggaagcctgctttcccaccatgcaaatactgaagcactaaacaaggagggaaatacaccacttttgcttgctgtaatttgtaagagacagtaaatggtggcatttttagtgaagaaccaggcaagtgcacctgctgttggtgattagtccattgtttagccagaaatcacacagaaagctagactagttagaagtagcaatgagtgcaagattctttcaggacttttaaagacctttatccccagggatctcagtgttcattttattccaagtataaccttatatataaccttatatgtgagatataaataacgtcacatttttacttgtttttctttctttctttctttcttttttttttagacaaggtctcactatgttgcccacattcctgagctcaactgattctcctgcctcagcctcccaaactgctagacaccatgcctggcctgacttttctaattagttattgggtcttgaaatgtccagtttagcagaaagtcttggattgtcccctggggctatctcctatgccttcatcctttgaatttttcaaaaagctaaggggttccctaagtccaaggaagacaatcttgctttacaagtcagaagatagggggaaaaggccattctaaatattctgtttccattgattcacttgtattgctgccattgtaactggtcctgcgatctggtaatgactaacctttgccaccaggatgcctttactgattcagacctctcactctttgtggtgactcacacacagagttcacagctacagtgatgcctttactgattcagacccttcagtctttgtggtgactcacacacaaagctcacagctacagtgttttttagttcatgtacatatgctcagccgttgttcccagcacactgctctggcagcgaggcctcctggctttacccacacacatagtgagtaaattgaccctcccctaacactaaaaaccttatttgttgcccacctcttagctaggcttagcctagaccttgatgagtcagggcttcactatggtctccaggctgctcttaaactcttggcttggagcagttctccttcctgggccttccaaagtgctgagattacaggtgtgagctactgtgcccagcctacattcagagtcttaaaacacgaaaataaatttgtcagaatagtagaggaaaacatttcagatgtaaaaatcaggatatacactaataaaggtataatggtaacaaaattttgcaaattattagtaaataacaactcacttagcatgttgttgaaaagatactattatgaagtagagaataaagtattactttatatgtttttactatatttttaaattttactttgtttccagcagttttgcttatttattttgcgtggaataatttgtgggtgaccctgagacttttgcatggcttgaacctgctgatatctagtgtctccttaagtggtttgttgaggttttagataattagaagtatttctttaaaatgtaaatattccagtaaacattaagcttcatttaaactctccatttataaaataaaagtatatgttattttgtatccatttttataaagattatagtctttatctaagtgttctaagtcattcattttaactaaacatatggatttgtctgcagaacacgacttaaaagtggcttcagaggaaaagcaagaaacgcttgaaagaagtgaaaataaacagccagagattttcaaagttatagaaaaaagaaggatgtgatatatacaaattgcatattgaagggagatattgccacactcaaacaggaataatacacaataaaaaatgacagtgtcaaaaaggaaaaggaatatattcaggaaattaagagtattagagaaataaatgctaactttgaaaaaagtgcaagactcaatgaggaaatgacaacaaaaacgatgtcccagtattgtcaacagcttaatggcctcaaagctgagaatacaaggctgaattcaaaattggagaaggaagaacaccacacagatggactggaagctgaagttgaattcttccattctaggctggctgctgctataaatgagcacaatgaaagtttagaaacgaaagacctagaacttgttttacagagagcacataatttttccgtacataaaaaaataagttctactgtttctcaactaaaagataaaaatgagttgcttactgaacaattttctaaagctcagatgaagttcaataccttaaaagaataaagtctggagtttagttaatagtaatgtaccaatgttaatttcaacaaatgtaccattgttatgtaaaatgttaacattagaggaaaccaggtgagggttatacaagaactctctgtactatctgcaacctagaataatctaaaactattgccaaataaaagccttttttaaatttttttgttattatactttaagttttagggtacatgtgcacaacgtgcagg

SEQ ID NO: 462383 - DNA, 1459 bp, Homo sapiens
gtcccaatgagatgaaccagtggtcctttaattctgaagttggagttggtgcccctgccatcacaaacaacacgagagccaattgtgagtcagtctcagtagccatcagcctggcagctgcccatcccataaccaaagagctcaatgggctggaggaaatacataaatacatttttgaggctattgctaccatagataatgatttatttgatggatttgtgccaagtaaattgaaaaccttctggaaaggattcaccatcctagatgccattaagaacatttgtgattcatgggagaaggtcaaaatatcaagattaacaggagtttggaagaagttgattctaaccctcatggatgactttgagggattcaagactttaatgaaggaagtcactgcagatgtggtggaaatagcaagagaactagaattagaagtgaagctaaagatgtttggtgcctggaatgctgacctagatctggaaactagcccagatgaaagcaagaatgatgaggccacagtgtccatgaaagtagggtgaggagggtgtccagtggagccagagggagtgccaagagggaggtccttggaacacggaggatccagaaggcccaggagtagaaagcagcgttggcatttgccacagctgagcagccttaactgacacctccttggcaccagcacacaaacaatggcccatggcctgacgtcttccaggatgccctaggcccgtgcccttcacctgttctgcagctgtaagactgtggtgtttgccctccttgattcttccaggtactgccccaccctgttcttctccccattctttgagtgctgagattggccagtcccatgctgagatgagggagctggaggaggggagactggctctcactcctcattgctgcccattgggatgggatgaacttcacagctctggtttcctctgttcttctctcagctgcaggtgatttaagcttgttggatttatataacattgggaaatggtaaactgtgtaaatttgctatgttttccagggacagttatttatggaagggcatttttaactcgagtgctagaagtgttaaatcattataataaattcatgctattcagactttcttacattgtaataaattttttctaagcatgaatgagaagatccatgattcttctaatataccattatgtatttcttctcaaaatgacacagcttactacaagttggagaataatagaaggagatttactgtgttggaggggaaaaaaagcagttgagcagggatgagtctgagaaaggactttggagcagtgatcacaagcagaacttctccctgcctctccgcttgcttagccagatggaaggaacaggcattgaggggttgcatccccttttcaatctcccacctgagcttagggacagcctttgtgcacagaaatggggcaccctagttgccctctgc

SEQ ID NO: 462384 - DNA, 1556 bp, Homo sapiens
gtcccaatgagatgaaccagtggtcctttaattctgaagttggagttggtgcccctgccatcacaaacaacacgagagccaattgtgagtcagtctcagtagccatcagcctggcagctgcccatcccataaccaaagagctcaatgggctggaggaaatacataaatacatttttgaggctattgctaccatagataatgatttatttgatggatttgtgccaagtaaattgaaaaccttctggaaaggattcaccatcctagatgccattaagaacatttgtgattcatgggagaaggtcaaaatatcaagattaacaggagtttggaagaagttgattctaaccctcatggatgactttgagggattcaagactttaatgaaggaagtcactgcagatgtggtggaaatagcaagagaactagaattagaagtgaagctaaagatgtttggtgcctggaatgctgacctagatctggaaactagcccagatgaaagcaagaatgatgaggccacagtgtccatgaaagtagggtgaggagggtgtccagtggagccagagggagtgccaagagggaggtccttggaacacggaggatccagaaggcccaggagtagaaagcagcgttggcatttgtaagaaagtagaagaggtggttggccagaggacaggccctgttcaagatctgaccaggacatcagagctggcctctccctcccttcttccttgcaggccacagctgagcagccttaactgacacctccttggcaccagcacacaaacaatggcccatggcctgacgtcttccaggatgccctaggcccgtgcccttcacctgttctgcagctgtaagactgtggtgtttgccctccttgattcttccaggtactgccccaccctgttcttctccccattctttgagtgctgagattggccagtcccatgctgagatgagggagctggaggaggggagactggctctcactcctcattgctgcccattgggatgggatgaacttcacagctctggtttcctctgttcttctctcagctgcaggtgatttaagcttgttggatttatataacattgggaaatggtaaactgtgtaaatttgctatgttttccagggacagttatttatggaagggcatttttaactcgagtgctagaagtgttaaatcattataataaattcatgctattcagactttcttacattgtaataaattttttctaagcatgaatgagaagatccatgattcttctaatataccattatgtatttcttctcaaaatgacacagcttactacaagttggagaataatagaaggagatttactgtgttggaggggaaaaaaagcagttgagcagggatgagtctgagaaaggactttggagcagtgatcacaagcagaacttctccctgcctctccgcttgcttagccagatggaaggaacaggcattgaggggttgcatccccttttcaatctcccacctgagcttagggacagcctttgtgcacagaaatggggcaccctagttgccctctgc

SEQ ID NO: 462385 - DNA, 6634 bp, Homo sapiens
tcccaggtagcccaggagactctccctttttggaagctacttcagaggaaaaggtgacagtaacactgtggaaatagatggatctggattccagtgtctcgactaccacttgctaattctgggaccttgcagaagtcgcatcacctctctgggctttaggaagggtcctgagacacacctagcacttcacattcactaagtcatgcgtgatcatcaaatcatttgattaattcccttactcttacagctgcctcaggatatggttcagtcatcacctccttcatccagccttctctacctctttgtcttaacattgaaatggccagcgtgttcttctacctgcctgccagacatgcaggcccaaggtaccaggaggcagatgctgacagatgcatctcagtatgcccggcacctccaccacacaagggctgtgctggttgctgtgggaatgctgcagggcacaaaacggataatgctggagggagaagacagcaaacacaaggctcaagaaactccagtatgtaagaagaggacatgcacaatggaagagggaagccaccatgcagaatgtcggggtgcacttttaaatgggacagtcaagggatcatcctggcagctatgtagagcattactataggggtcaagtaccgcagcagggacagcaattagtaggctactgcaagagtccagatgaggaaactgaggcttggcgtctcattgagtgacctacccaaaagttacccaaggagaaatgggctcgcagagatttgaatcctggtctccggccttcctttagacacttggggtgctcccaagtctgcatttggagaggggaacagcattaaagtatcagctggagcttctcagcttgaaatcctaggcctcttccagaggccagatgttcggatggtaccaaggggctctccgctgagtcctaggctgggagcagagagggaggggactctgttaccaaatcccaggctgggcactcccagggagtcccttcctccccacctgcatggcatctggcctccgccagctcctgcctggctgccagatataccagctgtggctcctctccacggagagtctcatttattaattaacactttcggttctagagggcagggcaggactgcctcatcctctgtgcctgatagccctggtagtgaccgaatgagctcaatgttctgccaattccagcaaggtgtcttgagattgttcaacctgtgcaggcagacacatcctcccaccagggcggcagcacggtccggtgactgtggtccattgctgactgttcccaggggccctaacacctacccccctacacatacacttccagtgccagggaagcacactctggcagccagaggaaccctaaggaagagtcatggcagaggctgtcagtaccacctgggcccggccctcaccttttacccacccctactggccatatcaagagggggttgtacctctgatggagattcggctgaatggacagaaaacctgggtcagacagccagcggcttcctggagagccagatatcccaaactgagccatctgggagacagaggggctcagaccagtggacagagaaaggcaggctgagcgtgtccaggaagtgtcagggtctgcatgctactgccaacctatgccagatgaccaatgccctgaagggctccaagggctagcattgtggctgggccccaagctgagtgaaccaggtcccctgactgtacaacctggaggcaatcatcttcgagagaccattgaagccagcctcccatgcccatgaccccgcgtcaatgctcagagcatgagtccatgggccattagtcttcctccacacgcaccagcttcataatgctgttgtgttatgtccttgtcccacttctccactccccctctcaacccctaaactctacctggagctggaaattcagagagtcttccctaagggttccctccatctcctgccttaactggaaccagggtctttcttgaagacacttcctcccctgcagccccccagagatgctgctgtctgctcatttactctgtaagaatcagaggtggggttggtatccatcttactctccattgctcctctttggcctagaaaacagtgcacctttgagggccgtgccattcagctctaccctttctccttgcctcattgtggtagacattattgttgatatcatgatcagcccccagaagcctttggcacctggctgaggtcttctttttcactttaagattttatttcatacttttggcttttttactttgtgcctttatcttgggtgaattcgacatccacaggaactatccatgcaacacgtaggcttctcaggtcctcaatctcatctccaataaccctctctcccacttcccccagtcactcattccctgtctcatcacaagccttgccatgaccccaaactgcagcccccagcatcactaactcaagcgtcctgctctctgaccaatctactctacttctttaaatcttgcatcatggtccttctttagcttcctcaagactttcatcaaccttttcatctttctctcaacctatcagctgtcttcctctgcttctccttttatcttggcatagactctgtggtccatcattttactaacgctcctaccagtactccaaattctcccccaccactttctcttctctacctgtttatcaaaaccccaatcttcaatgaacccaaccctttgctgtcttgtgctgcacacaaaccgacaaaattcatgatcactggcttcctgtgattctccaacgttttttcaccagcttcctcttttgccttccatgactttcaaacattcccagactcttcaaacctcatatgctttactcctgccctctcacgctcatcaggtgacctcaccccttcccagataaaatggaattgatcagaaagtaactctcctacaaatctacctacatcaccacccattctctcccctagccctgcatgagaggaggggtccttcctcctagctcctcctgtgttttgaaccccattgtctcccaccccacattattcattgtttcttctctctcctctgtatccatccacttcatctgaaaaggatctttcttgttgatatttaaacatttatgtctctcccatcttaggataaacctccttggctacaggtctccagttacaggtctctctcctctcctctccccctcttctctcctctcctctccttcactgccaaactgcctgaaagagttgtcaccatgtaatcccttggtataagttattggctaggaatatgggccctggagccagactgcctgcttttgaattccagttccatttctcagcagctgtgtgacatcaggcaaatcacataacctctctgatcttctgtttcctcttgtctataaaatgtaaacacatgtacctacctcaaagaatcattgtgagggttaagggagttaatatacataaagcacttagaacagggcctgcccatagtaagtgttcacttcctatttgccattgtttgctattattattattgctctgattgcttcctctcctccctgctccttcctccacccaataatctgacttttgccctttattctaccgaacagctctggctaaaagtactagtgttcttcttatctcttaacacaaaggacactttccaatcctcttctaattctcagcaagttgacctttccttcctactttaaacattctgtcccttctacctctctgagggttcctttaccagtttcctttgaagttttatcctcctgtcccagacatacatttgggtagcattgtcatgggtaactcactaccctccgtaagacaaggtctccccaattgatattgccaatccaaggctctcctctgacctcaagtcaaaatcctactcaacacttaagagttcccaaccactcttgaaatcaaatacaaccaaaatgaactcatgacttccctcccactccattttcccaaaacaaacctggtcctctttcagatgtcaccaccatctcttcggttttgcaagtcagaaacctggaagccatcatttttctctcctgcttcttcatcccctccaatcattccccaagtgattattacctcctaaagagccctcaccatttctactgcctattctctaattcaagccattctcatctcgtcccactacttgctgactaactggtctcaatgccagatccctctaccaatactaatttccacacagcacccaaaccgatcttttcaaaagacagatccagtttatcttcacctcacagccctgttctcttccaggttgacttcttgagctccaggtgttggaaaaatggctgccacagctccaagcctcacatcctttgcttttgagtcaaactgtctcttatccagaattcccttcaaagtcccatagcatctccatggctgtgatcaaactatgtgcctatcctcaaaccagttattgtggcccaggggatgcaatgtcatgagtggcttagcatgggttatgtgctcactgctgaagttgaggaataaactcccaactacatcacatgtactaaaaaaattggggagggctgtttctgcaaggagagccaatggctgccaaaaacagatggtgtccactacagttgccagtacaaacatgagtcgtggtatatcagtatttctctgactgtgttcagctgaatactaaactctcaaaatcctcttgagtggggaccaaaggagaaaaaatatttttgggtaaatacatttaagaaaacttgaattttattcccctgcctttacagaggcacagtgcatgttagcatattaggagcactgaaatctcctgcagctaagaaacctgtctggctttctttaacccagcatttcctaaacatatttcattgtatatcccttctatagttactatgtgtcccccaaagttcatgtgttggaagcttaaactctaatgcaacagtgttaggaggtggggcctaataagagctgattagattattatcatgagagtgcctttgttataaaaatgagtctgcctcctcttgctctcttgctttcatactctcttgcccttccaccttctgccatgggatgacacggcacaaaggcccttgccagatcctggtgccgtgctcttggatttcccagcctccataactgtgagccaaataaactttggttgttcataaataaccagtctcagtctgctattctgatcctggtgccatgttcttggatttcccagcctccagaactgtgagccaaataaatttgtgttgttcataaataaccagtctcagtctgctattctgcaacacaaagcaacccctttcccttacattcccctatagggatgtttttcaaacatactttgagaaacctccctggatgagaagacttcaaaaagtttgtggaaatgtgaagttaaaagataaaaatgaaaaatataaactttctcaacataaccttcatcaaggtcaagttgcttttgtaagcaatgataccagacatttagtccatctctaaagaactacaggtcctgggaatttgaccatgtcaatacagtcttttttacattattaactgaagaaaaatggataccctttacagatttttttaagattgggaaactaaaagcagtcagaggaagccaaatcaggactgtaaggtggaagcctaatgatttcccattgaaactcttgcaaaattggccctgtttgacaaaaggaatgagcaggaatgttcttatagtggggaaggattctctggtgaagctttctcaggcatttttctgctaaagctttggctatctttctcaaaacactctcataataagcagatgttatcattatttggcccttcagaaaatcaacaagcaaaatactttgagcatcacaaaaaaaatgttgccatgaccttgctcttgactggtccagttttgctttgactggaccacttccacgtcttggtagccattgctttgattgtgctttgtcttcaggattgtactggtaaagccatgtttcatctcctgttacaattcttcaaagaaatgcttcaggatcttcatcccatttgtttaaaattcccattgaaaactctgctcttgtctgcagctgatctggatacaatggttttggcactcaccaagtggaatatttgctcaacttaaattttttagtcagaattgtgtaagctgaactaattaagatgtctatggtgttggctattgtttctgctgttaatcactcgtcctcttcaattagggcatgagcaagattaatgttttcctcacaaattgatatggatggtctgcagctgaggacttcaacttcaacatcatctcatccttcttaaaaccagttacccatttgtaaactgttgatttctttggggtattgtctcctaaactttttgtaaagcattaatgatttcaccattcttccacccaagcttcaccataaatttgatgtttgttcttgcttcaattttagcaaaattcatgttgctttgataggggctcttttcaagctgatgtcttatccttcttagtgcctcaaaatagatcctgttcagacatgttataacaagttagtgc

SEQ ID NO: 462386 - DNA, 1810 bp, Homo sapiens
ttccctaattgctgtctctttgctgccaccttgtgaaggtgcctgcttccctttcgccttgcaccatgattggaagtttcctgaggcctccccagccatgcagaactcgagccctactctcaggcagtgatgctgtcctgaagtgtgaccatcccatggcactctggtacttctcttccattcttggggaagatccttctctgcttaattcaatgcctgacataaggaaactgcctgggggtagccttcaattgaccaaccctcagccctcccagactggcctctatcgctgccagggcaatgatgataccctcatggtacaatacgagatcgacttccaggttgtcaccacccttcatgttacgcacaagagcctggaccaaaagtccctgcagaatgagaccctgatcctggatggcaaggtactcatctttacccactgggacccccggcaggactgtaaccgctgtggggaactgggtgagtgcagacgcctggggtactgctacattgaggagcccgtggaaaaacctatgccctgccagctgtatctgagagatgagaagatgcaattcagccgcatgcggcccgaactgcagccccagtccaccatgccacccatgctgtggctgctgctccactttgctgccccggcactggggttctacttttccatcagctgccccagtggtaagcagtgccaacaggccctactctcaggcaatgatattctcctgtattgcaactcctcgggggcgcactggtactatttattcacacaaggcaagaagggcaggctcaccagcctcaccaatatttccaatatggaaataatgcccgagggcagccttctcattaaagatccattgccctcccagacgggcctctaccactgctggaacaagaatggccgccaagtggtgcagtatgaaattgactttcaggatgtcaccaccctgcatataacacacaaggacctgggtcagaggcccctgcagaacgagaccctgcatttgggcagcaaacagctcatttttacctggtgggagccctggcaggactgcaaccgctgtgaggagccgggcgagtgtaaacgcctggggtaccgctacattgaggagcctctggaggaagccatgccctgctggctctatctgggagaggtgctggtgtggtctagccgcttgcggcctgagctgcaggtggaagcctgccacgtccagtgcaccaataacacacagttaagggtggattacgtcatttttgacaacttcaggctcgatgagaagacagaatttgtgtggctcgactgtcccttaggatccatgtacaggcccgtcaactggcgtgccaacgacacccccctgacgtgggagagccagctctccggccaggacttcaccacctttctggacccctccaccggcggcaggcagctgcaggttttccagccggccgtctacaagtgcttcgtgcagcaggagctcgtggcccagttcaaacccgccgccagtctggagacgctggaggctcagtggagagagaacgatgcccagtggcgggaggcaaggaaggccctgcggggcagggcggactccgtgctcaaggggctgaagctggtgctgctcgtggtcaccgtcctggccctgctgggggcgctgctcaagtgcatccacccttccccgggcaggagaagcacacaggtgctggtggtgaaataaagcgagcccccggtgcacaagcggacccggcctccggttctctcttagccacagccgccccttctgtcacttccgccccggtgccccgt

SEQ ID NO: 462387 - DNA, 964 bp, Homo sapiens
caggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacactgctgctgcctggacctatacacaaggtcccacccctcaccggggccaaagacgtggtttcaggccctggtggatcctttctgttttgctccatccccgtcccctcttgcgcccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccag

SEQ ID NO: 462388 - DNA, 1668 bp, Homo sapiens
cgctgccgtgtaagtcctggaagccgcagacacctggggccaagcaaagcccaggaggcaggatggctgtgagctgtcgcttgccctgcaggtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccaactggagcggcagctgcagcagaggcaggaggatgacaaactcttcctcaaaatcaacggctcgtccaaccaggaggccttcgtgcgggagccgccagggctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggtttcaggccctggtggatcctttctgttttgctccatccccgtcccctcttgcgcccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccag

SEQ ID NO: 462389 - DNA, 1231 bp, Homo sapiens
tagttttcacccagcgggtgaggaggcagcgaagtcgcgggcccagcgtagcgcgcgcctccgaagggcttggtgcgggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaattcttgaatctgtaggtttatatattttgccaaatttggtaaaatttcagccatttaaaaaaattacttttaaagttgactccatcttgtccagaactgtacgtgcagcatagccattttccccaaacttctgtacaggtgaaatggccttctacgagaagtgggatttatgtgaaatgagagtccatagagatacctctggtttatttatttatttatttatgtatttatttatttagaaattgctatgtctttttttttactttaag

SEQ ID NO: 462390 - DNA, 1034 bp, Homo sapiens
gcaaagaaaggcggccggtcacctggggttaccacaacacagcgccgagatggtggaatccaccagaagtgctttgataatgttggacactattgtgcaggcaatggctgcctccttacccacgctgcataatgggcctctgagtgctaagaagataagcgatactatccttggagtgtcagagacaggataccactcgggacctcaatgcactcactctttcctggaaagggtctttattcacaggaatcccaggaacctggggcaagctttaggtttacttagaggaggaaaaacaaacaaacaaacaaacaaaggagagagaaggagactaaggaacaaagaaagaacagaggaatggagcaaaagaaaagaagggagagaaacaggaaggaacaaaagagaggctgacatacacatcctggacaaagcccctggccgggagttaagtgaagagaagaaggaagcaggtccctgccgccctacttctgggctgagctccatttgctggtgaacggggcttatcttcactctcccctttaaatactgtaacattcagcatcctttcatgtctgtgcttttaaagtaaatctttggacaattaaagatatgaaatggctaaatagagttctgcaggcgttgttctctcctttttaaagttttaatcacacttaatggctctcttcaaaacttgaattttccattttggtgttttgactccattgaaagagtttactaatattctttcaaaagtattctctgttcaaatgagctattcaataaagttttatgccatgctataggattcatgctaaatggaaaataatttaaagggagatcagagttgggggtgccattcctctctataggttttgttagccaaaccgtaatcaccaatattgagtccattaaaagttgctgtgaaggaacaggaattatcatttggatataaggaggaatctttcaaatgcaatttctatacctccttttcttgaagataatttcctgttcaccttgtgattctataaataggc

SEQ ID NO: 462391 - DNA, 918 bp, Homo sapiens
ggatttgctggtgcagtacaactaggcttaatagggagctcgaattcgagctcgaattcaacttctaacgttagaagcttgaattcgcctcgaattcgagctctttcctggaaagggtctttattcacaggaatcccaggaacctggggcaagctttaggtttacttagaggaggaaaaacaaacaaacaaacaaacaaaggagagagaaggagactaaggaacaaagaaagaacagaggaatggagcaaaagaaaagaagggagagaaacaggaaggaacaaaagagaggctgacatacacatcctggacaaagcccctggccgggagttaagtgaagagaagaaggaagcaggtccctgccgccctacttctgggctgagctccatttgctggtgaacggggcttatcttcactctcccctttaaatactgtaacattcagcatcctttcatgtctgtgcttttaaagtaaatctttggacaattaaagatatgaaatggctaaatagagttctgcaggcgttgttctctcctttttaaagttttaatcacacttaatggctctcttcaaaacttgaattttccattttggtgttttgactccattgaaagagtttactaatattctttcaaaagtattctctgttcaaatgagctattcaataaagttttatgccatgctataggattcatgctaaatggaaaataatttaaagggagatcagagttgggggtgccattcctctctataggttttgttagccaaaccgtaatcaccaatattgagtccattaaaagttgctgtgaaggaacaggaattatcatttggatataaggaggaatctttcaaatgcaatttctatacctccttttcttgaagataatttcctgttcaccttgtgattctataaataggc

SEQ ID NO: 462392 - DNA, 288 bp, Homo sapiens
  misc_feature (1)..(1): n is a, c, g, or t
  misc_feature (12)..(12): n is a, c, g, or t
ncccccgggctngcaggaaatcggcacgaggtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaataactgcc

SEQ ID NO: 462393 - DNA, 2075 bp, Homo sapiens
tttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaataactgcc

SEQ ID NO: 462394 - DNA, 1000 bp, Homo sapiens
gagccgggcccgtgtccaagccccgccccaccgccgcgcgctgagacaggccccacccccggctcgtgcagaactccgtactgttctgggtcaagcgcgcggagggcggcttgggccaccgcagagctgggagggaggagctaggagcggctgttttgggggcccggggcagctactgtctgggtgggaccgtgcggtgccggcccagccccggaggtgccggggagcgtcccgtccgcggatccccgcgcacgtggtgccgggcgtcccttcatggtctgtggccggattcgggctcgagcgccaggggcggctgggccagcaccttccgaccggtcgctttttgttcgcggaggccgctgggcgctaggcgtcgttctcggcctcgcaggagctcagaccgccgagcgcacaaggccgcagtgttcctgcaagcggccgccccgcgcggcaagtttggtccctgcacctcagtccctgctgtgtcctgcccctgcggatgctgagactggacgttcctgttttggcccagttctgctggcctctcctgagtggcccctgacacactggtccgcgatcgtgctagtctcttctgtccagggggcccctgggcttgccacactccctggggcgccgcagccgtgtcctgaggaaggaaaccaggagcttgcctgtacccaagacccgcaggaatgcggcccgggccctaaacgtttccaggaaaagtcaccttctggcacaaccctcaccctcacctttgcctttgcaggaggggagtgcgcgtgggcctggatgttcacctggactgggatctagttctcccgcctgctttgccgcgctctagcctcgtccctccagcccctctgcacttccgtctacggggcggaggagagacacaggctgtgctgcagcgtgtctattttttttctatacttttaagttcgcggcaaaattaaggggaaagtacatataccccctgccgtatccgtattatttcttt

SEQ ID NO: 462395 - DNA, 1288 bp, Homo sapiens
caaccagggtgatccagtgaaccctaatggattatattgttaaagctggacacattcaggcactgccttgtggaactgtgagaagagggctaccaccttccagaccccagaatggtagatccacgaacagcttgcattgtgtacctgcaaaagccacagacactcaatgccagcctgtgaaagcagccgggagggcggctgtaccctgcaaagccacaagggtggagctgtccaaggctgaggtagcccacctcttgtatcagcatgaactgaaggttgaagtaaaggagcctgccaaactccaccaaaaccaaaatggcaacgagagtgacttctggtcgtcctcactgctacactctcaccagcgccgtgacagtttacaaatgccagcccaacaggtgaacgcagagaactgcagcttgctggagcggaaacccacaagcaaaagcaacacggggaaccaacattgagcgtgagctggctacattctgttagtttgactaccaagtgaatagttactagcgcatcttacggggcgtttctttctgcatagatagcttttctacagcaaaggatcgttgaaaggtaatcacaaagataaaaaaaaatctcacaagtttgacattagcagactagaataaatgcaagtcagaccttgacagatatctatgacctgatttactgacgatatagaaaattttaaaaagcttagttattttgctaaaacagttttataggccaggcactgtggcttatgcctgtgataccagcgctctgggaggccaaagcaggaggatcgcttgaccccgggagttggtgaccagcctaggcaacaagttacatcaacagctgccaagtgtcttccaccaatcaaccttgacctacaattagaactcttcagttttgtagtggaaaaataaggacattcaaatttcagaatacatccttcgaagaataggatgtgccaggatcaattgctaagctgaaaagctagcagtgaccaaagaacaccaacaaagaaacccagcctccaaaagagaaaagtcattctgacataacagctacagaactgacaagtgttaaggacaaacatattaaaatttttatgctttcagagtctatgatacttcttattaattgaataattgttttgtttagaggaaatctctcatatctcaaaagcctagtctgaacatttttacatgtttctcagggagttgcaagagcttgaaaagaggaaaaatgccattcacaagtgttaaaagcaagtcgtatggtcaaggcatag

SEQ ID NO: 462396 - DNA, 1772 bp, Homo sapiens
ttttcaaatctgctccatgacagacgtcccaatgaccttgagcaagtcccttggcccctgagtctcagttttctgggtgggcttatcctccttcttccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactacaccttatgcctgctgggtgtttattttggtgtgtacccagggcatgtcggaggaagcctcgccaggcctctgtctttgtccaagataagaggcactatcagttatctatctagctctcaccaacttgccttgttctctctcctttttctcttattttcctcttccctttctgcccctctttcacccttttcttccccccccttcttgtctcttatctatttctttcttgtatctctttatctcttaaagaatctgttctatgactgtggaccaatcatctaattgacctatttcctgaactttagtttgtcctattagtaacatcttgcatgtggtgcatttgttataaatgatgggccaatattgatgcattaaataaagcccatagtttacattaggttaatgaatgtttagattcttagttttcattcaagtgagatgaacccaagtctggagttttccatacctttctctctatgtctcatttgatccatgacctcccccggccagtcctgtgaatgtggcatgacatttctcttctctggctctgccggtgtggatggtagcctaagctccttccagctctaaaatcccacaagtctctatttcaagttcctacctccctctattatccgtttgtctgtttaatctgttaacatttacaatggaggttgatcctgggaggaaaggtctgggctgcttttggggtgaagggagagggtcgaggagagcatttctctttccttggattttgtgtccactcaacacatgaaaatatattcagtcttcctagcctctgctcccgcccctttcccattgcagcacccaggagaaaggttctcagaaaacatccagatggtttcccagaccttatcaatatctacccttctcctctgccca

SEQ ID NO: 462397 - DNA, 433 bp, Homo sapiens
agtgactctacagatctaacctggtatcccacccaatgtcctcactaagttcctctgttcataggatagtaatacaaaacaaattgtaccccaatgcagcagtgtgaaaaaaaaagaaggaaaaaaggccaagattattaaattcttatgttcagactgagaaccagaaagcaaaagagagttaatcattgagttgtgtattagtctgttctctcactgctgataaagacattcctgagactgggtaatttataaaggaaagaggtttcattgactcacagttcgacatggccagcgaggtctcaatcatggtgaaaggcaaaggaggagcaaagtcatgtcttacatggtggcaggcaagagagagggcatgtgctggggaactcccctttatcaaacaatcacattgtgtgagacttactcactatcaatg

SEQ ID NO: 462398 - DNA, 2356 bp, Homo sapiens
taaggggtttgagcgatggtggtgactgaacagacaagccaaacccctgttgcaggtcctgtaaagatttgctttaattttctactcatgttgtccagtcgagtatggccatgtgtgcttctgtctctgatgagaaataataatgataaagatcatgagagcagcaggtaccactctgacaacgaagtgcccttctctgtcctagttattttaaaggagaatggaaagggagcttccttaagggatcctggccctgcagggctgtatggtctcacaggcaagggtgcctatctgctgggagaaaatgctttgtgtgctcatattcatgcaatcgacttggaaaaagagtttttgaagagtcctgctctcacaggacatctggagctcctaacatcccctactccccaacattcctccaggatcaagggcttcttccatgagcatgagttctataaaggaagtcaggaacaagcatgggcttggttggactgtacagttcaagaattagggaatttgaaggagtatggagtggtatgtgctccagataactgacctttgaaggtagtaatgtattatttacatgaaactaaaatccagtgcattctaaatggctgtgatttatcatgaccattttgaaattgggtcctgtggccatatgctaatttgactcaaaggaaattctgtgctgtgtgcttggatttcatgcttaaaaaattcagcaatagtttcaatgctcttttaattaaaataagatgctttataacatttcccacatgatgtggaatgtactctgtagctcatatatgaattaaaacccttagaagatttacattttctggtctggcaaccttcatttttctaatttatgtgtcctgtttgtcctgaaggagttgggaagttgaaatttacagccatcccaaatgagagagttgagattcttgattaaatgagagcttgtttgtgtattcaaatggaaaaatgtgggtggacaaaattaaatttgtagtgggttatctcctgaacagttttctctttcctggtaatttcacactgcccaactatgcacatggtaagtatgggagaaaacttttttgtataataaaactttttagcagtaactgactggaccatggttgggcatctattccaagttattctgatcagcacctgcatctgagactttgtaattggctctatcatattcccagtatgccttttgtgtgtggccattttctgctatgtaaataggaaaactgaaaaatcaggtctgcagaaattgaagaatgaatggggagaagcaaagacaagcaacagagagaaagaattcccagtcattcctggtgcgctgcagtctccagtttctgtgagtttccaagacccagctcatccatgcctttggggtctttgaaagatccctctatctttcaggggtctttgaaaaacccctgtttatttcaaccagctcagatggttgcctgcatgtgggagcaatgaaataacctatattgcttagatttctattttctgattagatggtggctaccatgctatgtgtatattcttaaaacaagcccttgtacataaattagataatattggatggttttggttgagctggtctttggcttaaatgttattgacatttttctgaaaaaatataataaatataggacatgtataatctcacacaagtttgaaactatttaatagactcttaaaacaaaggaagggtgtctatgtagatgtgctgattggttccaggtctaggaatccaggccatttgcagtttgatttgtggagaaggaaaagagactacaatctctcagtggtggtaaggaggcaggatggagtggggaccagaaacgcctctgagatacaatgtcccaaggtccagtgtttttatgattgggaggaagactgctctaaaatctttgacatttgaagattattaataataaatgtcctcactaagttcctctgttcataggatagtaatacaaaacaaattgtaccccaatgcagcagtgtgaaaaaaaaagaaggaaaaaaggccaagattattaaattcttatgttcagactgagaaccagaaagcaaaagagagttaatcattgagttgtgtattagtctgttctctcactgctgataaagacattcctgagactgggtaatttataaaggaaagaggtttcattgactcacagttcgacatggccagcgaggtctcaatcatggtgaaaggcaaaggaggagcaaagtcatgtcttacatggtggcaggcaagagagagggcatgtgctggggaactcccctttatcaaacaatcacattgtgtgagacttactcactatcaatg

SEQ ID NO: 462399 - DNA, 571 bp, Homo sapiens
tctagagcggccgcctactactactaaattcgcggccgcgtcgaccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgatttggaaaaaaaaaaactatttaaaaatataaggctgacgcg

SEQ ID NO: 462400 - DNA, 4719 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462401 - DNA, 4841 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462402 - DNA, 2145 bp, Homo sapiens
tctagagcggccgcctactactactaaattcgcggccgcgtcgaccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462403 - DNA, 3105 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgatt

SEQ ID NO: 462404 - DNA, 3103 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcaccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462405 - DNA, 831 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctggtttctaaggtgataggagataagcctggagctgctcgtggtcaccttgccaccatggggggagaacctgccagaaaatgaaactaaccaaaaaggaagctgagctaagaggagtgaccagattactgacatgtctcttaaacacctggatccatctgttcctgaaggcaaaactgttcaattacataggctaataaattccctttcttccttaaacaaacagaata

SEQ ID NO: 462406 - DNA, 904 bp, Homo sapiens
atcctgaggctgcagccagctttcccacaggtctaccgagacattacaacgctcagcttcaggacttcactctgcttctcgctggcttccatccccttgtcctgggagctggggggatcaggacatttttatagaccctcactctggggtctctctaccttgcccttcagcacagggttatcctggtgcctctccacagctcctcctctttccttccagactcaacaagggtacgccctccactctctcagttggtctctctactttcctgccttgtgctccctgagtgtgttgaccctcattctacttcttttacctcctttccttcaggcccatttttccttcctatccctggggcatagcagatggccacatcagggagtaacttaagcccaggcctgaatgctgccaagagcatctgccctgccatctcccaagccggggttcctccaggtggatcaggttaggtggtgaggattcctggggtattacccatggtagagacgtccccagcatgagaagcagggccctgaaccagagaccacaggaatctcaggctgtaccccatccagtcagtctgcagctcccttcttggctcaccacgctcaggctcgtgtacatgaggcctctgcagcctcctcttcagcacatcagtgttcctcataggtgactaactcatgcacaggctctcacaacttctgctttctgtttctgtcacctcagcatattggctgtttccaaacataggtagccatgcctttactaacaaatatacctccatatcctctagtagtgacacttgagttgcatagttaccacataagcgtctttcccctttaacagcatgccgctcttggaagcagggcttagctgattcaccctgtattcccagctcctgacatca

SEQ ID NO: 462407 - DNA, 4928 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgaggtacggagacgctggggctgagggacttgcgggctcggtccttcctgagaggtgacggaatgcaagtgggggcgacttcggcaaaggggagactcacattgggacttgtcctcctcctcctggacattttgggggctcgtcagcatggacagcgagtcagccatgggtggaagggaggctttctcacagctcccttgtgcttcccacagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462408 - DNA, 4737 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgaggaatttgtgaccctcaaggatgtcggcatggacttcaccttgggagactgggagcagctcgggctggaacagggggacacgttctgggacacagcgttggacaattgccaggacctcttcctgctgggcttttcccaggagagcagccagcctgctgtgtcgccctcttctgcacaccagtgtcacacagtgagacagcagcagggcccagactccagctaagaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggccttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaagt

SEQ ID NO: 462409 - DNA, 3112 bp, Homo sapiens
aacccgtcacaacgcgtttccatggcaacctaccgcttgctcttcggaaaaggttaacactccctgacttctagtaaagtgctaaggctgaagaagcaggaggagatgggaaggcgaaagaagtcgcccgcacagccctctgggaaatagagtcctggcgctgccgcggaggatcctgggtgcagccgctcagagaagcttctcgcgcacaggaagtcgctgcgaggaggcgcgtgtgcggggagttgaatctcccgctcccttgaggctggggttgcgtctgttgacgcggccgactacaatcccgagccctgccagccgggaacacggaggggaaggaggaggagcttaaaagaggctactgaaccccagttggccatggctgaggaatttgtgaccctcaaggatgtcggcatggacttcaccttgggagactgggagcagctcgggctggaacagggggacacgttctgggacacagcgttggacaattgccaggacctcttcctgctggaccccccaagacccaacctgacctcccacccagatggcagtgaagatctggagcctctggcaggaggaagcccagaagcaacaagccctgatgtgactgagaccaagaactctcctctgatggaggatttcttcgaagaaggattctcccaggagattatagagatgttatccaaggatggcttctggaactccaatttcggagaagcctgtatagaggacacctggttagatagtttgctaggcgatccagaaagtcttctgaggtctgatattgccaccaacggggaaagtcccacggaatgcaagagtcatgaattaaagagaggactcagtcctgtgtccaccgtttccacgggagaagattccatggtgcataatgtttctgaaaagaccctcacaccagctaagtctaaggaatataggggtgagtttttctcctactccgaccacagccagcaggattctgttcaggaaggggagaaaccatatcaatgtagtgaatgtgggaaaagcttcagtgggagttaccgtcttacccagcactggatcactcatactagggagaaacccactgtccatcaagagtgtgagcaaggttttgaccggaatgcttccctttctgtgtatccgaaaactcacacgggctacaaattctatgtgtgtaatgaatatgggacaacttttagtcagagtacatacctgtggcatcagaaaactcacactggagaaaaaccatgtaagagtcaagatagtgaccacccacccagtcatgacacacagcctggtgagcatcagaaaactcacacagatagtaagtcctacaactgtaacgaatgcggcaaggcttttacccggatcttccaccttactcggcaccagaagatccacactcggaaacgctatgagtgttccaagtgccaggcgaccttcaacttgagaaaacacctcatccaacatcagaaaactcacgctgcaaaaactacctctgagtgtcaggagtgtgggaagatttttaggcacagttcgctgctcattgaacaccaggctcttcatgctggagaggagccttataagtgtaacgaacgtgggaaatccttcaggcataactctaccctaaagatccatcagagggttcacagtggagagaagccttacaaatgcagtgagtgtgggaaggccttccaccggcacactcaccttaatgaacatcggcgaattcatacaggctacagaccccacaaatgtcaggaatgcgtcaggagtttcagccggccctcacatctgatgcgacatcaggccattcacaccgcagaaaagccctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatctgtgccctcacaaccccagatgaaagttagtacatatgctggggcatgatgccctgaaatgaatgtgattcaatgatggatccgtaaga

SEQ ID NO: 462410 - DNA, 921 bp, Homo sapiens
ggccaggagttccaaatgcatgtggctgggctggaggcgaggtgttggcagggccaccatgttccttctggaggctccagcacgtagatagtccttcctggcccgttgccagcttctggaggtcacctgtattgcttgactcatggcttctcagtcttcaaagacagcagtggcgttttctccgctgtggcctgtatccctcctggatggtgactctgttcccttccttggggaagcttgtggagggtatggctcaggactgcttgggctctgggaccctgacattttctgtccctggcccatggaggcctcaggcaatgtgtggcccatgggtcagtgaataaatcatgaatggctaaggaagtacgtgcctctccacctggcagatcctgcccattaaagagctgtcacaagtcctttgtatccccagccccagctgtcacagctttgatcaccctggattgtgattgtttggctccctctccatcactggactgggaaccctacaggacaggcatccccagagtcgcccagtgcagcacctcgtccacacacaggagccacgtgcaggataaagcatagaaaagtcaggagagccaggaggttctcactgagtgtctggatggtcctccatgtcctggttgggtgacaatgcttttctctccctgcagaccccccaagacccaacctgacctcccacccagatggcagtgaagatctggagcctctggcaggaggaagcccagaagcaacaagccctggtgagtggatggagaggggccccttgtgtaccttctgtcttccagacctccatcctgaggctgcagccagctttcccacaggtctaccgagacattacaacgctcagcttcaggacttcactctgcttctcgctggcttccatccccttgtcctgggagc

SEQ ID NO: 462411 - DNA, 2463 bp, Homo sapiens
gtgagactcagagaggcagtgacctggccaggggcaggcagctttcctatctaaaagggcaattactccaagcaaccaggaaggccagaaccaggggacaaatttcccaacatgactctgggaaaggccagcccgggcctctcgggatctcaagccctcggcctgtgtgtgtgccagagcttcccacagactcgggaagaagtcaaggaactctcactgcgcccttgtttggacaagacgaggaggcgcactcagagtcagagaccccggggcagagacaggggcaagaagaaggggccaccgagaccccaagagagtcagggagacagacgcaccaaacgaccgacacaaccagggacaggttcaagcaattctcctgcctcagcctcgcgagtagctgggattacagatatccttcgagttggatttcgactgggttctgccagtgggatgtatccatgcgagattctggaactaacatcagagagagtccaagcttctaacttttatcagcggcagtgacaatagtcaagcagcattgatgacaaacggcaagagtttagaaagtaccagtgacgtgcctgatagaatctcaccacaagatggaagccaactcgtcagaagcctggaaagcccacccagcgtgggacctctgtgggtccaggatcttggaatggtatcccatggttcaatcttctggattcaaccacataaatttaccccacccatgtcgtggacccaagcttcctaccatgtatacttagcttaaatgcaagatagtactattttgttcatcttgattggagtgagaaatgaataggtccatgcacatatatttcttttaccacaacaagatgatgaagaaataaatccataatatcgatacttttgtataagttgtgtttacagttgcggtaagaaattttataattgttgatttgctttatataatttctgcttgctttttatgatatttaaaacaaaatctaagcaacaaattttatgtctgattagatttacagaagctgcttaagtgcttagggataatttgttcatcatatttgtaagtctcccttgttaggtgtttgaagtgtttgaattggctaaattaaatttgtaattgtagtttgaaatatctaaaggaattttcttaattaagtgtttaaatgatgttaaaagtttgtgggaatttaatctatcaaatttatgagttaattgaatatgaatcaatgaacaagtaaatgtgatcttgcttttatataaaaactactaagttcataaataaaatacaaagatccataagttgagaggaaaagcaaaagagccagattctaagatctataacttaaaaaaattaaatattgattgaaatgtaagtcattgcaattatccccactagctgaaatctcacatctgagtgcttacacacaaaacaaaatgttaccctgaacatactaaacaaataaaaaaccacgtggtaattactatacacatgctcactgctggaagcattcatactgcactcaaatccaggtgggagaatgcagcgtgtgctacaggtgaatctcggctgttctcttatggggatcaggtctttttcttaattatcttccacggatttttcttcctttacccagagacctggaggccctcccagcccaggtccaattcagatggatacatacttaacatcactaacctattgatttgcttgtttatttacactgcagcacatgtttgttgtggtgcagaaggaaaacctccttcacatcttatactgaataatatcaatgcacagaaacctacccactgattgtttgcttagggttaagttactgggtgattttaaaataataacaatgtttttatttgcttccattaaaacgctttgttttaggcagaagtccttgaaaggttgctagataggtgttaacaatgcttttgagatatttgagttcatttgttgggagttgggtgggcccggaatgccatagactcaaacatttttccttccaacacatcttcgggaacagattcagttgatgtggtggaaattcttgtacttcccttctgggcacagagtgcttctcacagagagaaggaaggctttgcttctctcttgtcactggaacatttaatttcctatttgtttttcatctctgtctgggaaatctccaaggaggacgattgatttgccaagaggtgtcttctattccaaggccttggccaagtcaccatatttacaccatcagaacctcacctagccccttcaacaaaggatgtaattgtagatattgagaaatgattccactctccctgcttgaaggactggctttggggcagctttctgaaggccaagcttcagttcataggatgttaatacatgtctgagcagatgagggtattagttgtgccatccatgttttaacccttgattttacagtgtggaaacttgagggtcac

SEQ ID NO: 462412 - DNA, 2068 bp, Homo sapiens
tcccctccgactgagccccatagaccccctactcaggccagaaggggaaagctgagctcctgctggcccaggcatcagaattcctcagggaggaaaagttgcctatctgttgggtcagatttctgaagactgatgaggcccattttctgacaaacggcaagagtttagaaagtaccagtgacgtgcctgatagaatctcaccacaagatggaagccaactcgtcagaagcctggaaagcccacccagcgtgggacctctgtgggtccaggatcttggaatggtatcccatggttcaatcttctggattcaaccacataaatttaccccacccatgtcgtggacccaagcttcctaccatgtatacttagcttaaatgcaagatagtactattttgttcatcttgattggagtgagaaatgaataggtccatgcacatatatttcttttaccacaacaagatgatgaagaaataaatccataatatcgatacttttgtataagttgtgtttacagttgcggtaagaaattttataattgttgatttgctttatataatttctgcttgctttttatgatatttaaaacaaaatctaagcaacaaattttatgtctgattagatttacagaagctgcttaagtgcttagggataatttgttcatcatatttgtaagtctcccttgttaggtgtttgaagtgtttgaattggctaaattaaatttgtaattgtagtttgaaatatctaaaggaattttcttaattaagtgtttaaatgatgttaaaagtttgtgggaatttaatctatcaaatttatgagttaattgaatatgaatcaatgaacaagtaaatgtgatcttgcttttatataaaaactactaagttcataaataaaatacaaagatccataagttgagaggaaaagcaaaagagccagattctaagatctataacttaaaaaaattaaatattgattgaaatgtaagtcattgcaattatccccactagctgaaatctcacatctgagtgcttacacacaaaacaaaatgttaccctgaacatactaaacaaataaaaaaccacgtggtaattactatacacatgctcactgctggaagcattcatactgcactcaaatccaggtgggagaatgcagcgtgtgctacaggtgaatctcggctgttctcttatggggatcaggtctttttcttaattatcttccacggatttttcttcctttacccagagacctggaggccctcccagcccaggtccaattcagatggatacatacttaacatcactaacctattgatttgcttgtttatttacactgcagcacatgtttgttgtggtgcagaaggaaaacctccttcacatcttatactgaataatatcaatgcacagaaacctacccactgattgtttgcttagggttaagttactgggtgattttaaaataataacaatgtttttatttgcttccattaaaacgctttgttttaggcagaagtccttgaaaggttgctagataggtgttaacaatgcttttgagatatttgagttcatttgttgggagttgggtgggcccggaatgccatagactcaaacatttttccttccaacacatcttcgggaacagattcagttgatgtggtggaaattcttgtacttcccttctgggcacagagtgcttctcacagagagaaggaaggctttgcttctctcttgtcactggaacatttaatttcctatttgtttttcatctctgtctgggaaatctccaaggaggacgattgatttgccaagaggtgtcttctattccaaggccttggccaagtcaccatatttacaccatcagaacctcacctagccccttcaacaaaggatgtaattgtagatattgagaaatgattccactctccctgcttgaaggactggctttggggcagctttctgaaggccaagcttcagttcataggatgttaatacatgtctgagcagatgagggtattagttgtgccatccatgttttaacccttgattttacagtgtggaaacttgagggtcac

SEQ ID NO: 462413 - DNA, 746 bp, Homo sapiens
agcacaaaccagtgcagcggtatgaacctgtatgggtggccattgcattcctcactacccacatttaaaaagaagtcagttttacttaagaaagtttttgataaaggtgtaacaattttttattttattaaatctccacccgtgagttcccatctttttattattctgtccaaaccactggtagcagcccctggtatatccaggacatcagcacatagaaccagtgaaagggtcctccctcatagtgacgcatgtcatagactcagatttatacaaacaaatgctgagcaaaccatgaagagtctctggtattttcaacaatatcatcacagaggaactgtattgatttccttgaacttttcaaatgtagaggagcctttagaaggaagccttgagcatgaggacagacccccctcatccaaccaccacctgactctgtgtgaacctggaactgttagaatgtctgtgctgtgataaaaggtcatctccctacaatgttatgatacagacctcaaacctacaaacatgaggaacttctgcctccaggttaactgcttacccactgtacaagacacgttacacacagtccaggaggcggagcttctgagatatctagaaacagcttagaggcaaaatgacaaaataaagcagcaacaacaaataaaaccaatcttctcgaactggctctcgctttggtctaactagttatgcactacttggataactatatcaagttcccttgagtc

SEQ ID NO: 462414 - DNA, 539 bp, Homo sapiens
cagatggggtttgcaggagcaatggctgtagggacactaagatttcaccctccagaagacagcatcttcctgtgccatggctagatcaccagctacccacagacagcctgaactccaattgtcttcctgcacatgtgcctttaaaggaacttttcaaatgtagaggagcctttagaaggaagccttgagcatgaggacagacccccctcatccaaccaccacctgactctgtgtgaacctggaactgttagaatgtctgtgctgtgataaaaggtcatctccctacaatgttatgatacagacctcaaacctacaaacatgaggaacttctgcctccaggttaactgcttacccactgtacaagacacgttacacacagtccaggaggcggagcttctgagatatctagaaacagcttagaggcaaaatgacaaaataaagcagcaacaacaaataaaaccaatcttctcgaactggctctcgctttggtctaactagttatgcactacttggataactatatcaagttcccttgagtc

SEQ ID NO: 462415 - DNA, 644 bp, Homo sapiens
agcacaaaccagtgcagcggtatgaacctgtatgggtggccattgcattcctcactacccacatttaaaaagaagtcagttttacttaagaaagtttttgataaaggtgtaacaattttttattttattaaatctccacccgtgagttcccatctttttattattctgtccaaaccactggtagcagcccctggtatatccaggacatcagcacatagaaccagtgaaagggtcctccctcatagtgacgcatgtcatagactcagatttatacaaacaaatgctgagcaaaccatgaagagtctctggtattttcaacaatatcatcacagaggaactgtattgatttccttgcacgttcagggtactgggagaggcaacagggatggaggtcccatgtcaggggacttcacagtgtgacgggaatgttcaacctgcacctgttccttgcaccatactccatccagctctccgctcttccagtcatttatgctcctgtcttccgtggaggaagtctggtagtatctccccgggacactggctcaaatttccagccacctgcccaagacagatgggaccaggggccagatgatgtggacaatgatgatgtcacaaagagaagtaagaaataaaggaggcaactt

SEQ ID NO: 462416 - DNA, 4170 bp, Homo sapiens
cagctaagacgctaggaccccctggaagcctagaaacgggagtgttgacatttagggatgtggccatagaattctctctggaggagtggcaatgcctggacaccgcacagcagaatttatataggaatgtgatgttagagaactacagaaacctggtcttcgtgggtattgctgcctctaagccagacctgatcacctgtctggagcaaggaaaagaaccttggaatgtgaagagacatgagatggtagctgaacccccagttgtatgttcttattttgcccgagacctttggccaaagcagggcaaaaaaaattatttccaaaaagtgatactgagaagatataaaaaatgtggatgtgaaaatttacagttaagaaaatactgtaaaagcatggatgagtgtaaggtgcacaaagaatgttacaatggacttaaccagtgtttgacgactacccagaacaaaatatttcaatgtgacaaatatgtgaaagtctttcataaattttcaaattcaaacagacatacgataagacatactggaaagaaatctttcaaatgtaaagaatgtgaaaagtcattttgcatgctttcacacttagctcaacataaaagaattcatagtggagagaaaccctacaaatgtaaagaatgtgggaaagcctataatgagacctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccagttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcgtcacaacttactacacataagataattcatactggagagaaaccctacaaatgtgaagaatgtggcaaagcttttaaccagtcctcaactctttctaaacataaggtaattcatactggagagaagccctacaaatatgaagaatgtggcaaagcttttaaccagtcctcacaccttactacacataagatgattcatactggagagaaaccctacaagtgtgaagaatgtggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaatgaacagtgtggcaaaacttacacaatgctcaaaccttattgcacaggaaagcctttatacttgagaacaaatgtacaaatataaagaaagtaaaaaagtgattaatatctgtgcacatcttattcaacatcagagtttatattaatagcattaaaagtgcaattactgtcaaaagagttcaaaaaataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcgaagaaaaaccctgtaaatgtaataaatttagaaaaaaacatttattcaaaaactacaggttagaaaattccagagagttcatattaaaatatttttgcatatacagtaaatagaaaaaaatatttaattcaatggtaagtttatgtaaatatcagagaatttatgttagaaatatataaggcaatgacacttcagactttacactgaatcagagttctgagtttagaaagtaatccaaaactaaacttggcagaaaaattatttgtttataactttaaaagagtagaagattttttggagagttacaagtatacttttttttagaaagattacagattttttttaaaagtaaataactctcaaattacttcatacaaataatgttgtaattaactcaaattacttcgtgttaatgttgtaattaactctcaaattacttcatgctaaggaaattagtttttctttttcttcttctttttttttttttttttagatggagtcttgctctatcgcccccccaggctggagtacagtggcacgatctcagctcactgcaacctccgtctccagggttcaagtgattctcctgcctcagcctcccaagtggctgggattacaggcgcaaaccaccatgcgtggctaaattttgtatttttaatagagccagggttttgccatgttggccaggctggtctcgaactcgagactttaggtgatccgcccagcttggcctcccgcaatgctgcaattacaggtgttagccactgcgcctgcctgatgttgtttctttattcctattgtattcatatgtgaaagcatgtgaccaaaagatatgaggattattttttattaggtgagcatttatgacctcttctatgaaagagtaaggacattaaaatgcatgatgaaaatctaagtaaagaggttctttgtgattcacttacagtactgagtgatgcatgaggtaggtgttctgagtaatattctgcattatattgagagacaaatttttagttttagttaaaattaaaaataaattagtatattattttactaattttacttttatgaaaatgcagtacatgttaaaaattttagattatgtgtgaacttaatttcttaattcaacatttttaacagtttaaatattgtgcattcaatcaagtcacattattccacttactttaacctagtccaccttactcaagggtgtaggtaaaaggtggtaacaaggccgggcacggtggctcacgcctgtaatcccagcactttgggaggcaaaggtgggtagatcacctgaggtcgggagttcaagaccagcctgaccaacatggagaaacgccatctctactaaaaatacaaaattagccaggcatggtggcgcatgcctgtaatcccagctactcgggaggctgaggcaggagaatcacttgaacccgggaagcagaggttgcggtgagccgagatcatgccatggcactccgtcctgggtgacaaagtgagactccctctcaaaaaataaataagtaaataaaataaatggtggtaacaatacactatttggtaaaagaatgcactaacatctgtagtactaatcttttttccagtggctttaaactgcaaataaggaatgttgtttctgtaggtaaaatttttatttattttttcccatttaaatttacttttgttagttttttcaggcatataatatttatgttatatatggcatattctgataagaggcatacaatatgtaataatcacattagggtaaatgaggtatccatcacctttagaatttattttttgtattatgaacagttcaattgtacagttttagtttttttaaaatatacgattgttattgactacagggttatttttataataaaaattatatacaagtataaaatttacacatttctgagtcctgaataaataaaaataatttcttgtatatttttctttgaatatgtggcctctctacttgcaaa

SEQ ID NO: 462417 - DNA, 4332 bp, Homo sapiens
aggatcttgaaggaaagatgcagatgaaaatacccaaattcaataatcggttagaactggcggggggaaaagctaagtccactggtccacagaaactgcagtcacctctccccctagggactcaggcccagggagatcagagttctgtccctgagcccctggctggagttgttggagttcctgcagagtggccccacacaggagtgttgacatttagggatgtggccatagaattctctctggaggagtggcaatgcctggacaccgcacagcagaatttatataggaatgtgatgttagagaactacagaaacctggtcttcgtgggtattgctgcctctaagccagacctgatcacctgtctggagcaaggaaaagaaccttggaatgtgaagagacatgagatggtagctgaacccccagttgtatgttcttattttgcccgagacctttggccaaagcagggcaaaaaaaattatttccaaaaagtgatactgagaagatataaaaaatgtggatgtgaaaatttacagttaagaaaatactgtaaaagcatggatgagtgtaaggtgcacaaagaatgttacaatggacttaaccagtgtttgacgactacccagaacaaaatatttcaatgtgacaaatatgtgaaagtctttcataaattttcaaattcaaacagacatacgataagacatactggaaagaaatctttcaaatgtaaagaatgtgaaaagtcattttgcatgctttcacacttagctcaacataaaagaattcatagtggagagaaaccctacaaatgtaaagaatgtgggaaagcctataatgagacctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccagttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcgtcacaacttactacacataagataattcatactggagagaaaccctacaaatgtgaagaatgtggcaaagcttttaaccagtcctcaactctttctaaacataaggtaattcatactggagagaagccctacaaatatgaagaatgtggcaaagcttttaaccagtcctcacaccttactacacataagatgattcatactggagagaaaccctacaagtgtgaagaatgtggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaatgaacagtgtggcaaaacttacacaatgctcaaaccttattgcacaggaaagcctttatacttgagaacaaatgtacaaatataaagaaagtaaaaaagtgattaatatctgtgcacatcttattcaacatcagagtttatattaatagcattaaaagtgcaattactgtcaaaagagttcaaaaaataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcgaagaaaaaccctgtaaatgtaataaatttagaaaaaaacatttattcaaaaactacaggttagaaaattccagagagttcatattaaaatatttttgcatatacagtaaatagaaaaaaatatttaattcaatggtaagtttatgtaaatatcagagaatttatgttagaaatatataaggcaatgacacttcagactttacactgaatcagagttctgagtttagaaagtaatccaaaactaaacttggcagaaaaattatttgtttataactttaaaagagtagaagattttttggagagttacaagtatacttttttttagaaagattacagattttttttaaaagtaaataactctcaaattacttcatacaaataatgttgtaattaactcaaattacttcgtgttaatgttgtaattaactctcaaattacttcatgctaaggaaattagtttttctttttcttcttctttttttttttttttttagatggagtcttgctctatcgcccccccaggctggagtacagtggcacgatctcagctcactgcaacctccgtctccagggttcaagtgattctcctgcctcagcctcccaagtggctgggattacaggcgcaaaccaccatgcgtggctaaattttgtatttttaatagagccagggttttgccatgttggccaggctggtctcgaactcgagactttaggtgatccgcccagcttggcctcccgcaatgctgcaattacaggtgttagccactgcgcctgcctgatgttgtttctttattcctattgtattcatatgtgaaagcatgtgaccaaaagatatgaggattattttttattaggtgagcatttatgacctcttctatgaaagagtaaggacattaaaatgcatgatgaaaatctaagtaaagaggttctttgtgattcacttacagtactgagtgatgcatgaggtaggtgttctgagtaatattctgcattatattgagagacaaatttttagttttagttaaaattaaaaataaattagtatattattttactaattttacttttatgaaaatgcagtacatgttaaaaattttagattatgtgtgaacttaatttcttaattcaacatttttaacagtttaaatattgtgcattcaatcaagtcacattattccacttactttaacctagtccaccttactcaagggtgtaggtaaaaggtggtaacaaggccgggcacggtggctcacgcctgtaatcccagcactttgggaggcaaaggtgggtagatcacctgaggtcgggagttcaagaccagcctgaccaacatggagaaacgccatctctactaaaaatacaaaattagccaggcatggtggcgcatgcctgtaatcccagctactcgggaggctgaggcaggagaatcacttgaacccgggaagcagaggttgcggtgagccgagatcatgccatggcactccgtcctgggtgacaaagtgagactccctctcaaaaaataaataagtaaataaaataaatggtggtaacaatacactatttggtaaaagaatgcactaacatctgtagtactaatcttttttccagtggctttaaactgcaaataaggaatgttgtttctgtaggtaaaatttttatttattttttcccatttaaatttacttttgttagttttttcaggcatataatatttatgttatatatggcatattctgataagaggcatacaatatgtaataatcacattagggtaaatgaggtatccatcacctttagaatttattttttgtattatgaacagttcaattgtacagttttagtttttttaaaatatacgattgttattgactacagggttatttttataataaaaattatatacaagtataaaatttacacatttctgagtcctgaataaataaaaataatttcttgtatatttttctttgaatatgtggcctctctacttgcaaa

SEQ ID NO: 462418 - DNA, 4089 bp, Homo sapiens
  misc_feature (3051)..(3051): n is a, c, g, or t
  misc_feature (3075)..(3075): n is a, c, g, or t
  misc_feature (3078)..(3078): n is a, c, g, or t
  misc_feature (3088)..(3088): n is a, c, g, or t
  misc_feature (3095)..(3095): n is a, c, g, or t
  misc_feature (3100)..(3101): n is a, c, g, or t
  misc_feature (3109)..(3109): n is a, c, g, or t
  misc_feature (3112)..(3112): n is a, c, g, or t
  misc_feature (3139)..(3139): n is a, c, g, or t
  misc_feature (3151)..(3151): n is a, c, g, or t
  misc_feature (3153)..(3155): n is a, c, g, or t
  misc_feature (3161)..(3161): n is a, c, g, or t
  misc_feature (3163)..(3163): n is a, c, g, or t
  misc_feature (3183)..(3183): n is a, c, g, or t
  misc_feature (3197)..(3197): n is a, c, g, or t
  misc_feature (3200)..(3200): n is a, c, g, or t
  misc_feature (3208)..(3208): n is a, c, g, or t
  misc_feature (3214)..(3214): n is a, c, g, or t
  misc_feature (3219)..(3219): n is a, c, g, or t
  misc_feature (3225)..(3225): n is a, c, g, or t
  misc_feature (3227)..(3227): n is a, c, g, or t
  misc_feature (3232)..(3232): n is a, c, g, or t
gcaacagcctggggccgagaagcgaaacttggtcttctccaccctcgtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaagcactgcctctctcacagccctcaagacacaccatgggccccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaacgttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacaattatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccnaggcaggtggatcatgaggtcagnagntcaagaccancctggcnaacanngtgaaacnccntctctactaaaaatacaaaaattagcngggcgtggtggngnnngcctgnantcccagctacttgggaggcngaggcaggagaatngcntgaacccnggaggnggagnttgcantnagccnagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttat

SEQ ID NO: 462419 - DNA, 2342 bp, Homo sapiens
gcaacagcctggggccgagaagcgaaacttggtcttctccaccctcgtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaagcactgcctctctcacagccctcaagacacaccatgggccccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaaggaccgcggaggtaacagtcccagccgcgagccagggaacgcgcgggggcgggcgcgcgcctcggtggagctcatgcccgcctgggtactaagtactgggattggctaaagggtattcctcagccccctctggacttgtgccgccgtgcaagggccaccctgacccgcagcggggaaggaagcgccgaccggaggagtggaaagatggtcgtgtggagcgacccgggcagggctggggcgctctgcccaacatcgggcatcaatttaggggagtcagagctgcctttttctgcaggccttcacgaggggacagcgaattactgcagggtcggtttcatttcggttccctctaccctgcggatgtttctacagaaaccacttccatttccttctttaacgctcgcgggccagagtccccagctgaggatctaacctgtcagtctttttccctccctcacccaggtgggcagagaggaaggagaaattttgtgagtgggcatttcgagggattgctgagtttagtgaattgaattgagacctcacccatactttcaccgaaatggggtaactcatttttcctgaactgatgttccccagtgtttgataacttgagctgattgctgtttctccagtgtggtggtccctgccaaaaatctgccactttggtggccgtcactgtaacctcaagtagtctggcaaatcagactgacaaagtaacctgaaaaacaagactattaattagagttttcgtctaaatggacaaaagggatgctgacaaagacctaacactgagtcacagatgaagtttcatgttaatcccatgtaaggcacctgtgaggtaaaaatcagcggacctgagtcacaatgggatgacatagtttgtggtagactattgatacgcggaggagtgggttttcagcttagagcacggtgataggctgcaagtttacctgctgactcgtgaagaggatgaagcatcttcccaaactgatttaagccaaacgatctcaaagaaaactgtcaggagcatacaagaggctccaggtaagaatagttaactttttgtttttctccttacctaccaactttttaaatgttcattgaattaaacaatgtaagtatgtgtaaagaaaagacaagggcagacacagcccttttactttccccccaagtgcctcactatcattctctcatgtcataactagctactcagtaaaatttgttcaatgtcaaatgaatgaatatgttatactgccctgtgtttaaaatggattaacttttcttcatggtaaaatcttgacacagtgtgatcagtcttttcagtttaatactgtggtttatcaaatcttaagatgctatc

SEQ ID NO: 462420 - DNA, 5054 bp, Homo sapiens
  misc_feature (4016)..(4016): n is a, c, g, or t
  misc_feature (4040)..(4040): n is a, c, g, or t
  misc_feature (4043)..(4043): n is a, c, g, or t
  misc_feature (4053)..(4053): n is a, c, g, or t
  misc_feature (4060)..(4060): n is a, c, g, or t
  misc_feature (4065)..(4066): n is a, c, g, or t
  misc_feature (4074)..(4074): n is a, c, g, or t
  misc_feature (4077)..(4077): n is a, c, g, or t
  misc_feature (4104)..(4104): n is a, c, g, or t
  misc_feature (4116)..(4116): n is a, c, g, or t
  misc_feature (4118)..(4120): n is a, c, g, or t
  misc_feature (4126)..(4126): n is a, c, g, or t
  misc_feature (4128)..(4128): n is a, c, g, or t
  misc_feature (4148)..(4148): n is a, c, g, or t
  misc_feature (4162)..(4162): n is a, c, g, or t
  misc_feature (4165)..(4165): n is a, c, g, or t
  misc_feature (4173)..(4173): n is a, c, g, or t
  misc_feature (4179)..(4179): n is a, c, g, or t
  misc_feature (4184)..(4184): n is a, c, g, or t
  misc_feature (4190)..(4190): n is a, c, g, or t
  misc_feature (4192)..(4192): n is a, c, g, or t
  misc_feature (4197)..(4197): n is a, c, g, or t
gcaacagcctggggccgagaagcgaaacttggtcttctccaccctcgtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaagcactgcctctctcacagccctcaagacacaccatgggccccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaaggaccgcggaggtaacagtcccagccgcgagccagggaacgcgcgggggcgggcgcgcgcctcggtggagctcatgcccgcctgggtactaagtactgggattggctaaagggtattcctcagccccctctggacttgtgccgccgtgcaagggccaccctgacccgcagcggggaaggaagcgccgaccggaggagtggaaagatggtcgtgtggagcgacccgggcagggctggggcgctctgcccaacatcgggcatcaatttaggggagtcagagctgcctttttctgcaggccttcacgaggggacagcgaattactgcagggtcggtttcatttcggttccctctaccctgcggatgtttctacagaaaccacttccatttccttctttaacgctcgcgggccagagtccccagctgaggatctaacctgtcagtctttttccctccctcacccaggtgggcagagaggaaggagaaattttgtgagtgggcatttcgagggattgctgagtttagtgaattgaattgagacctcacccatactttcaccgaaatggggtaactcatttttcctgaactgatgttccccagtgtttgataacttgagctgattgctgtttctccagtgtggtggtccctgccaaaaatctgccactttggtggccgtcactgtaacctcaagtagtctggcaaatcagactgacaaagtaacctgaaaaacaagactattaattagagttttcgtctaaatggacaaaagggatgctgacaaagacctaacactgagtcacagatgaagtttcatgttaatcccatgtaaggcacctgtgaggtaaaaatcagcggacctgagtcacaatgggatgacatagtttgtggtagactattgatacgcggaggagtgggttttcagcttagagcacggtgataggctgcaagtttacctgctgactcgtgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaacgttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacaattatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccnaggcaggtggatcatgaggtcagnagntcaagaccancctggcnaacanngtgaaacnccntctctactaaaaatacaaaaattagcngggcgtggtggngnnngcctgnantcccagctacttgggaggcngaggcaggagaatngcntgaacccnggaggnggagnttgcantnagccnagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttat

SEQ ID NO: 462421 - DNA, 4035 bp, Homo sapiens
  misc_feature (2997)..(2997): n is a, c, g, or t
  misc_feature (3021)..(3021): n is a, c, g, or t
  misc_feature (3024)..(3024): n is a, c, g, or t
  misc_feature (3034)..(3034): n is a, c, g, or t
  misc_feature (3041)..(3041): n is a, c, g, or t
  misc_feature (3046)..(3047): n is a, c, g, or t
  misc_feature (3055)..(3055): n is a, c, g, or t
  misc_feature (3058)..(3058): n is a, c, g, or t
  misc_feature (3085)..(3085): n is a, c, g, or t
  misc_feature (3097)..(3097): n is a, c, g, or t
  misc_feature (3099)..(3101): n is a, c, g, or t
  misc_feature (3107)..(3107): n is a, c, g, or t
  misc_feature (3109)..(3109): n is a, c, g, or t
  misc_feature (3129)..(3129): n is a, c, g, or t
  misc_feature (3143)..(3143): n is a, c, g, or t
  misc_feature (3146)..(3146): n is a, c, g, or t
  misc_feature (3154)..(3154): n is a, c, g, or t
  misc_feature (3160)..(3160): n is a, c, g, or t
  misc_feature (3165)..(3165): n is a, c, g, or t
  misc_feature (3171)..(3171): n is a, c, g, or t
  misc_feature (3173)..(3173): n is a, c, g, or t
  misc_feature (3178)..(3178): n is a, c, g, or t
gcaacagcctggggccgagaagcgaaacttggtcttctccaccctcgtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaagcactgcctctctcacagccctcaagacacaccatgggccccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttacgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaacgttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacaattatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccnaggcaggtggatcatgaggtcagnagntcaagaccancctggcnaacanngtgaaacnccntctctactaaaaatacaaaaattagcngggcgtggtggngnnngcctgnantcccagctacttgggaggcngaggcaggagaatngcntgaacccnggaggnggagnttgcantnagccnagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttat

SEQ ID NO: 462422 - DNA, 1311 bp, Homo sapiens
cgatccaaccaaccctcaaagattcgcaccgcgcggcacgcacccagcaggttccagcgtaaaagctgctccggtcccaagcgcgtctccaaacccctcctttacagcgccgcctccccagccagccccggtgcgcagtggcgaacagcccgcagagcccccaggcttacctgtagcatgtggtgagctcgcctgaagacttcagacacgggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattttgcaccagggtctcacgaccgggaggaggaggagctgattctccaccggggagaagagggagggggaagagaggggttaataagcttccttcctgttgtccatgggtttctaaagcccagggtcaggccagtgttcgtctttcctccattatgtgaggaaggaggagttgaaaggctacaacgggcctctcaaattgttcaaacctgaaatagcgctatttatatagtgtaatcactcttccttaaaacctttagaagaaagttctctggttgtttcattggtcaataaaccatgcgctgtcttcttcataactcgagttcggaacaagtaaggaggtctttctgggagccttacatctccttgtcctgagcggctttaatactgtttccacgccgcgcacatcagagctggaaacgcccccccccatcaaatgagacacgtgggggcaaattaattacaggtgctgctacctgctagtgtatgcagccgcgttgataggtaacaagaaaacggaggaggggggccgtaaatcggctcccttgacggtgaccctaattgtaattcgtgtgtcagcaacttaacactttgttgc

SEQ ID NO: 462423 - DNA, 2101 bp, Homo sapiens
ggaaatgtaaaccactagggctctctcacttaccctttcccagcactaggagcctttcccggctttcaggtgatcacggccagaagggctacctcccttcgctctccttttaaacaggaccacatgaagagtggtcttgccagcaaatctgggaacaaactgcaagttgacgcaggactatctataattcacataggagagacaccttctgagcatgggaagtgtaaaaaattcttcagtgatgtctccatccttgatcttcatcaacaattacactcaggaaagatatcccatacatgtaatgagtacaggaagagattctgttatagctcagctctttgtcttcatcagaaagttcacatgggagagaaacgctataagtgtgatgtgtgtagtaaggcatttagtcagaactcacaactgcaaactcatcagagaatccacactggagagaaaccattcaaatgtgagcagtgtgggaaaagtttcagccgtagatcaggaatgtatgttcattgcaaattacacacaggagaaaaacctcatatttgtgaggaatgtgggaaggccttcattcacaattcccagcttcgggaacatcaaagaatccatactggggagaagccattcaaatgttatatatgtggtaagagcttccatagtagatcaaatcttaataggcattccatggtccacatgcaagagaaatcatttagatgtgatacctgtagtaatagctttggtcagagatcagcacttaatagtcattgcatggaccacacaaaagagaaactatacaaatgtgaagaatgtggaaggagcttcacttgtaggcaagatctttgtaagcatcagatggaccatacaggagacaaaccatataattgtaatgtatgtgggaagggcttcaggtggtcctcatgtctttcaagacatcagcgggtccacaatggagaaacaacattcaagtgcgacggatgtgggaagagattttatatgaattcacagggccattcacatcagagagcctatagagaagaagaactgtataaatgtcagaagtgtgggaagggctacattagtaagtttaatcttgacttgcaccagagggtccacacgggagagagaccttataattgtaaggaatgtggaaagagcttcaggtgggcctcaggtattttgagacataagagactccatactggagaaaaaccattcaaatgtgaagagtgtgggaagaggtttactgagaattcaaaacttcgtttccatcaaagaattcacactggagaaaagccttacaaatgtgaggagtgtggaaagggattcagatgggcctcaactcatctaacccatcaaagactccacagcagagaaaaactattccaatgtgaggattgtgggaagagcagtgagcacagttcatgccttcaagaccaacaaagcgaccacagtggagaaaaaacatccaaatgtgaggactgtgggaagcgctacgagaggcgcttgaatctagatatgattttatcattatttttaaatgatatataattattgtccatatttatgggttacagcatatttcaatacatgtatacaatgtataatgatcaaatcagtgttattagcatatccatcacctcctttatcatttatttgtggatcatttatcatttctttgtgctttgaacgttcaaaaactgctgttctagttatttgaaaataagttattattaattatagtcacctttagtgctgtggaacactagaacttgttcctttcatcatcttactgtactttcatatcttttctataacaaaatagtacactgtttccacaaacttgggaaggctagtatttgggggtggggggcgtggaaatcactaaacaacaaagaaaatctgatgaattggacagcataaaaatattggcataaagatgaacataacataagcaggaatatttaaagcacatactttttatagagtgtctcccctgtaatgtctctggttaaatgaaagggtttcaaatgtgaagacaaccctaaccatactcattatctgtaaaagatgtagcattgtcatggactccttaataaac

SEQ ID NO: 462424 - DNA, 1744 bp, Homo sapiens
acctgcttcatcacaggacgcaccaggagatgacccgtcacgagatgctgctgcatgcatagcaggccctgcagcccggggcccacagcacccctgctaaccaggctcccgtgcagcatttcctgcctatagtcaaagagctctctctagagaagaggaagtccccattgttcaagactacccaaaacaccagccttctctgcacggcacgtcgaggaaagaataactgtgcagtgaacagcactggcccaagtctgcagggcgaggaagaagccaggacataagcaaagacaaatcttactagaaacagaacgaacttgcaggcttcccttcagatgacgatgactgcgagtgaagaggaaatcctctcccagcatctcttcctgctggtggaagctgcaggtcacctgaccacacatgacaagacagtgtgactcagatccagcgtctgccgtgaagtttggtctcagggccctgctcatcaagaaatgtttttgaaaaaggtggaagtaggtagagggacgtgctctgaaccagcgtgaccaaaagacagtgtgttcacggtgcattcatctgattcaattcctgccaaaggcttttgttatttgagaacattatgactaaaccaacagagaggaaggacattctgaatacgggtgagagactgcgcgttggacaatcactgtgagtcccgacccttaccagaaaagtcactcgcagcgtcgtttccaggcataggttaggatcaccatgctctcccacgggccgtatgttgcaatcctgatatgaaaacgtcttctatctccttcaactgcggcaggagcacagctctgcagatttgctggggctctgtggcgcagtggaggcgaggacagaggtggccctgctctgggagatcccttcctaactggggctccctgacggcttcctgcacaggaggggcccgacgccggcgggacaagcagggagcccagatcagccttggaaagctcaggctcaaaccagagctcaatgtggaaattaaaaaacaaaccttgactttgtgttggtttttattcttccacttaaaaagttatttgaagcgtaacgtgagatcctggagaggactgaaatggcatgtcctaggttcatgtttatcctggttataaattgtctttttatgaagttgaaagccatgttgaaattaggtcattttaaaagaatttattaaaagttatgaaaatcgccaaggtgaccatggaaaggaggccagcaggcacgctctgcctcttggggagaatgccaggccccgggccactctcatcccagagggagcagtggcgaccaccccggacctggacacagccagccagggccacggcctcaggccatagccacgaccacgcagagctcacaggcaccccccagcctgcagacctgggggccatcctcggcctgtttctctgccctttctttatctccaattataaagcagcgccaggttttcttgtcagcctctgccatgtctccaaatggcttttcggtgtcaggcccatcaggaaattaactcatcatgcctcatcttccatccaccagtgcctgcccccacaacttcttggctgtaaaccttcgcttgctcctgtattcagaaccgagcccagttctgtgcccaggtcttttttcccctactgacattttcctgaataaaatctgggttttacctgtgcaactactgtccagctctggtttttctgtgatactctgc

SEQ ID NO: 462425 - DNA, 2084 bp, Homo sapiens
acctgcttcatcacaggacgcaccaggagatgacccgtcacgagatgctgctgcatgcatagcaggccctgcagcccggggcccacagcacccctgctaaccaggctcccgtgcagcatttcctgcctatagtcaaagagctctctctagagaagaggaagtccccattgttcaagactacccaaaacaccagccttctctgcacggcacgtcgaggaaagaataactgtgcagtgaacagcactggcccaagtctgcagggcgaggaagaagccaggacataagcaaagacaaatcttactagaaacagaacgaacttgcaggcttcccttcagatgacgatgactgcgagtgaagaggaaatcctctcccagcatctcttcctgctggtggaagctgcaggtcacctgaccacacatgacaagacagtgtgactcagatccagcgtctgccgtgaagtttggtctcagggccctgctcatcaagaaatgtttttgaaaaaggtggaagtaggtagagggacgtgctctgaaccagcgtgaccaaaagacagtgtgttcacggtgcattcatctgattcaattcctgccaaaggcttttgttatttgagaacattatgactaaaccaacagagaggaaggtgagtaagcaaacaggaaaaactgatgacgaattgacaatccatgtatttatccacccatttaaagtaacttgctgagcgcctacctagctgcacaagaagctcagggcctgaagatgaacacgcagaggctgtgtgcaggggcatgagcttacagctggaattagagataaaggaaaaggcacctgagccctgtgacatgcggggggtcaggggaggtgggacatatgtggcctcgtagccagagccccgcctgtttcccaggacattctgaatacgggtgagagactgcgcgttggacaatcactgtgagtcccgacccttaccagaaaagtcactcgcagcgtcgtttccaggcataggttaggatcaccatgctctcccacgggccgtatgttgcaatcctgatatgaaaacgtcttctatctccttcaactgcggcaggagcacaggtgaaagaggggagcccagactgggggtagactgtattcgtgggttatggccctatttacagatcagtcatgatagctctgcagatttgctggggctctgtggcgcagtggaggcgaggacagaggtggccctgctctgggagatcccttcctaactggggctccctgacggcttcctgcacaggaggggcccgacgccggcgggacaagcagggagcccagatcagccttggaaagctcaggctcaaaccagagctcaatgtggaaattaaaaaacaaaccttgactttgtgttggtttttattcttccacttaaaaagttatttgaagcgtaacgtgagatcctggagaggactgaaatggcatgtcctaggttcatgtttatcctggttataaattgtctttttatgaagttgaaagccatgttgaaattaggtcattttaaaagaatttattaaaagttatgaaaatcgccaaggtgaccatggaaaggaggccagcaggcacgctctgcctcttggggagaatgccaggccccgggccactctcatcccagagggagcagtggcgaccaccccggacctggacacagccagccagggccacggcctcaggccatagccacgaccacgcagagctcacaggcaccccccagcctgcagacctgggggccatcctcggcctgtttctctgccctttctttatctccaattataaagcagcgccaggttttcttgtcagcctctgccatgtctccaaatggcttttcggtgtcaggcccatcaggaaattaactcatcatgcctcatcttccatccaccagtgcctgcccccacaacttcttggctgtaaaccttcgcttgctcctgtattcagaaccgagcccagttctgtgcccaggtcttttttcccctactgacattttcctgaataaaatctgggttttacctgtgcaactactgtccagctctggtttttctgtgatactctgc

SEQ ID NO: 462426 - DNA, 1973 bp, Homo sapiens
agtctccccatctgcaaagtggggatgatgagatcacctcccttagagtgttattatgagggtggaggaagaaatacaggtatggtgcttagcacagtggctggcataggttgagtccccggatgatgagaccaggaagggtcatgtcgtcatccctcacctgctccataaacaacagagagcctcagggttgggctccagagggaggagtttgggaagaaatggggtcatgggctggctcctgggatatggacaagaaaggagcttgtctttcctggctctgctggagtcctgccgcggaggcttggttaccatggcgacgggctccatggaaacttgcagccggccttttccaggatgggcctggaccccagcccacctgctgatgcattgcgtcccctggccgcagcatcccgaggaggtgcccgggtggtcactctgctgtctgagcacccacccctccaccttggcaggggcagggagagtcctgaagggcagcaggatgggattctggcatgcagaggccattgagtggcttcaggatcccgcatcaatccaggacacagagacccacaattctctcatatttaggcaaattgagagcaagtctttacatggctgctgctcaatgtcctgcccattctgtttcggtgtcctggtctgttttggtcctggtgctgcattctcttcactctgtttctccctggcccagctattctctgagttctgatctgttcactccaccatgtgcacaccatgccccaggattcttattcccagtttgctggcaaagacactgaggccaagaggatggaggaccctgtccagggtcacacatgtggcagagcaggaaggagaacgtaggcatgtctgactccgaagttgccttgaagagggtaccaccgtgttatttgggaaactcatttgaacccaacagaactcctttcccgggggcccctgaggaggctgtcatcccaactcacgctcacccaaggaagtaccagctggtgatcttggtggcattggcaacggagcctccccagtggcttccagcaagtcactggggccttgcccatgggggaactgacaaggaggaaggtcgcacctgccattggaaaccagagagacagcttctgtgcacccaagagactccttggaggctccaagggagaaatactaccatgggatggttactgtagactgacatggtttgagaatagagagaaaaaaatgtattattaaaaacccaaacagtctgttccacttcccactctgcttctaaggcagaggatggggggtggtggtgtaattcatgtctcagggagataaaattctgcacaacttcctttgctgcacagaacccagtgggagacaagggggacaatggatattccagagcctttgcaggttttccggagctgcggctccacaggggacctggagtgggtggcctttggtggagcaggaatattttgtgggtctccagaggggtcccgtgacttctgatacagaccctctttccagcccttaaaaacactcagcttcattggtaataataacaataaagccagcacacctatgcaataccactgtcatcttgtacatttaggggattaaaaaaaagtaactggtgaggatctagtgaaatgtctctcttatacgctgcaggtggaactgcgaattgggaacccctttgaaagcaactggaaaatatttattgaaagccataaaaatgttcctatttctggaaccagtaatcttatttgaggatctgtcctagggaaataatataaactatggaaaaagtctgtgcacaaagatgtccagttgaatgttatttataagaatgcaaaacaacactgcttcagtgtgcaatgacaagggaaaggtggtgatgggtcaacccaatggtatatgaggtcatcatgagagctgaaacagtgaagccatatctttgcagtcacatgaatctt
